US011060098B2

(12) United States Patent
Minshull et al.

(10) Patent No.: US 11,060,098 B2
(45) Date of Patent: Jul. 13, 2021

(54) INTEGRATION OF NUCLEIC ACID CONSTRUCTS INTO EUKARYOTIC CELLS WITH A TRANSPOSASE FROM ORYZIAS

(71) Applicant: DNA TWOPOINTO INC., Newark, CA (US)

(72) Inventors: Jeremy Minshull, Los Altos, CA (US); Sridhar Govindarajan, Los Altos, CA (US); Maggie Lee, San Jose, CA (US)

(73) Assignee: DNA TWOPOINTO INC., Newark, CA (US)

( * ) Notice: Subject to any disclaimer, the term of this patent is extended or adjusted under 35 U.S.C. 154(b) by 0 days.

(21) Appl. No.: 16/842,719

(22) Filed: Apr. 7, 2020

(65) Prior Publication Data

US 2020/0318121 A1   Oct. 8, 2020

Related U.S. Application Data

(60) Provisional application No. 62/831,092, filed on Apr. 8, 2019, provisional application No. 62/873,338, filed on Jul. 12, 2019, provisional application No. 62/982,186, filed on Feb. 27, 2020.

(51) Int. Cl.
| *C12N 15/67* | (2006.01) |
| *C12N 15/52* | (2006.01) |
| *C12N 15/10* | (2006.01) |
| *C12N 15/85* | (2006.01) |
| *C12N 15/62* | (2006.01) |

(52) U.S. Cl.
CPC ......... *C12N 15/67* (2013.01); *C12N 15/1082* (2013.01); *C12N 15/52* (2013.01); *C12N 15/625* (2013.01); *C12N 15/8509* (2013.01); *C12N 2830/007* (2013.01); *C12N 2830/42* (2013.01); *C12N 2840/203* (2013.01)

(58) Field of Classification Search
None
See application file for complete search history.

(56) References Cited

U.S. PATENT DOCUMENTS

| 7,932,088 | B1 | 4/2011 | Adams et al. | |
| 9,670,503 | B2 | 6/2017 | Craig | |
| 2008/0263730 | A1* | 10/2008 | Andersen | C07K 14/415 800/312 |
| 2012/0027847 | A1* | 2/2012 | Kusk | A61K 38/22 424/451 |
| 2017/0101629 | A1 | 4/2017 | Minshull et al. | |
| 2020/0318107 | A1 | 10/2020 | Minshull et al. | |
| 2020/0318135 | A1 | 10/2020 | Minshull et al. | |

FOREIGN PATENT DOCUMENTS

| WO | WO 2017/062668 A2 | 4/2017 |
| WO | WO 2020/210236 A1 | 10/2020 |
| WO | WO 2020/210237 A1 | 10/2020 |
| WO | WO 2020/210239 A1 | 10/2020 |

OTHER PUBLICATIONS

Sequence Alignment of SEQ ID No. 7 with SEQ ID No. 55960 of U.S. Patent Application Publication No. 2008/0263730. Sequence Search Conducted on Sep. 18, 2020, 1 page. (Year: 2020).*
Sequence Alignment of SEQ ID No. 8 with SEQ ID No. 55960 of U.S. Patent Application Publication No. 2008/0263730. Sequence Search Conducted on Sep. 18, 2020, 1 page (Year: 2020).*
Belancio et al., "Mammalian non-LTR retrotransposons: For better or worse, in sickness and in health," Genome Research, 18;343-358, (2008).
Bonizzoni et al., "Highly similar piggyBactransposase-like sequences from various *Bactrocera* (Diptera, Tephritidae) species," Insect Molecular Biology, 16(5):645-650, (2007).
Bouallegue, et al., "Molecular Evolution of piggyBac Superfamily: From Selfishness to Domestication," Genome Biol. Evol. 9(2):323-339, (Jan. 12, 2017).
Daimon et al., "Recent transposition of yabusame, a novel piggyBac-like transposable element in the genome of the silkworm, Bombyx mori," Genome, NRC Research Press, 53:585-593, doi:1 0.1139/010-035, (2010).
Deininger et al., Alu Repeats and Human Disease, Molecular Genetics and Metabolism, 67, 183-193, (1999).
Doherty et al., "Hyperactive piggyBac Gene Transfer in Human Cells and In Vivo," Human Gene Therapy, 23:311-320, (2012).
Genbank Accession No. NW_0133535463.1, *Anyelois transitella* strain UIUC subculture of SPIRL-1966 unplaced genomic scaffold, ASM118610v1 Atra_scaffold_0159, whole genome shotgun sequence, 1 page, (Aug. 2015).
Genbank Accession No. XM_133335311, Predicted: *Amyelois transitella* piggyBac transposable element-derived protein 4-like (LOC106135111), mRNA, 2 pages, (Aug. 2015).
Genbank: : Accession No. ABD76335.1, "transposase [Heliothis virescens]," Direct Submission on Feb. 19, 2006, Entomology, Kansas State Univ, retrieved @: www.ncbi.nlm.nih.gov/protein/abd76335.1.
GenBank: : Accession No. PCG77621.1, "hypothetical protein B5V51_6758 [Heliothis virescens]," Direct Submission on Sep. 2, 2017, Department of Entomology, Univ. of Maryland; Retrieved on Dec. 8, 2020 @: www.ncbi.nlm.nih.gov/protein//PCG77621.1.
GenBank: BAF64515.1, Transposase [oryzias latipes (Japanese medaka), Mar. 22, 2008, retrieved @: www.ncbi.nlm.nih.gov/proein/BAF64515.1.

(Continued)

*Primary Examiner* — Channing S Mahatan
(74) *Attorney, Agent, or Firm* — Alston & Bird LLP

(57) ABSTRACT

The present invention provides polynucleotide vectors for high expression of heterologous genes. Some vectors further comprise novel transposons and transposases that further improve expression. Further disclosed are vectors that can be used in a gene transfer system for stably introducing nucleic acids into the DNA of a cell. The gene transfer systems can be used in methods, for example, gene expression, bioprocessing, gene therapy, insertional mutagenesis, or gene discovery.

23 Claims, 1 Drawing Sheet

Figure 1:
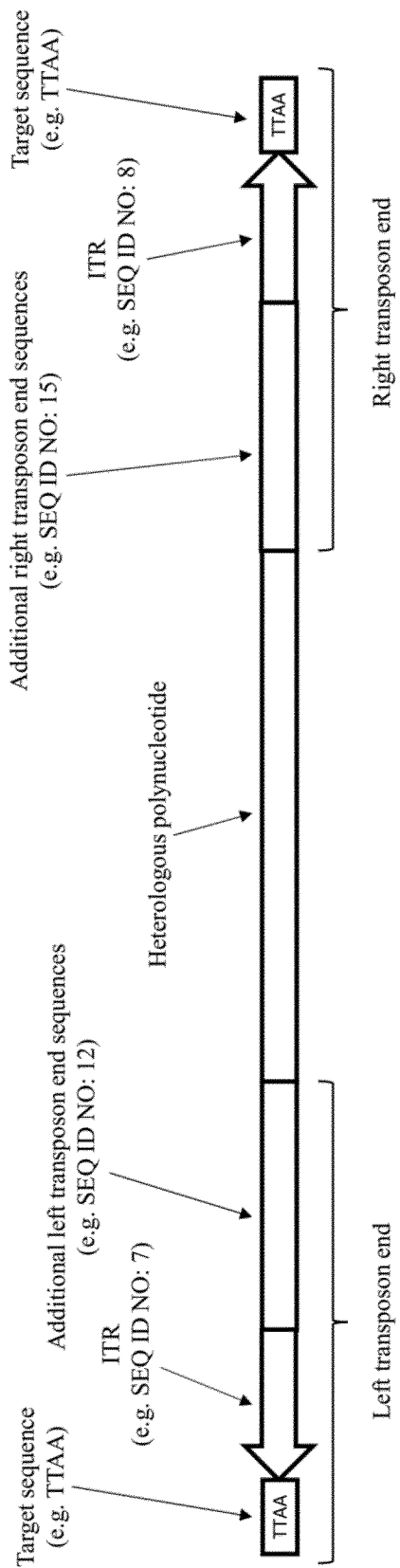

Specification includes a Sequence Listing.

(56) References Cited

OTHER PUBLICATIONS

Handler et al., "The piggyBac transposon mediates germ-line transformation in the Oriental fruit fly and closely related elements exist in its genome," Insect Molecular Biology, 9(6):605-612, (2000).
Hikosaka et. al., "Evolution of the Xenopus piggyBac Transposon Family TxpB: Domesticated and Untamed Strategies of Transposon Subfamilies," Mol. Biol. Evol., 24(12):2648-2656, (2007). [Retrieved from the Internet Apr. 14, 2014: <URL: http://mbe.oxfordjournals.org>].
Le Rouzic et al., "Reversible introduction of transgene in natural populations of insects," Insect Molecular Biology, 15(2), 227-234, (2006).
Li, et al., "piggyBac internal sequences are necessary for efficient transformation of target genomes," Insect Molecular Biology, 14(1), pp. 17-30, (2005).
Luo et al., "A new active piggyBac-like element in Aphis gossypii," Insect Science, 18:652-662, (2011).
Luo et al., "Molecular characterization of the piggyBac-like element, a candidate marker for phylogenetic research of Chilo suppressalis (Walker) in China," BMC Molecular Biology, 15:28, 12 pages, (2014).
Mitra, et al., "Functional characterization of piggyBat from the bat Myotis lucifugus unveils an active mammalian DNA transposon," PNAS, vol. 110, No. 1, 234-239, (2013).
Muñoz-López et al., "DNA Transposons: Nature and Applications in Genomics," Current Genomics, 11:115-128, (2010).
NCBI Reference Sequence: XP_023815209.1, piggyBac transposable element-dirived protein 4-like [Oryzias latipes], BioProject: PRJNA193868, Feb. 15, 2018, retrieved @: www.ncbi.nlm.nih.gov/protein/XP_023815209.1.
NCBI Reference Sequence: XP_030017403.1, piggyBac transposable element-dirived protein 4-like [Sphaeramia orbicularis], BioProject: PRJNA556027, Aug. 2, 2019, retrieved @: www.ncbi.nlm.nih.gov/protein/XP_030017403.1.
NCBI References Sequence: XP_026724774.1, piggyBac transposable element-dirived protein 4-like [Trichoplusia ni], BioProject: PRJNA497582, Oct. 25, 2018, retrieved @: www.ncbi.nlm.nih.gov/protein/XP_026724774.1.
Sarkar et. al., "Molecular evolutionary analysis of widespread piggyBac transposon family and related 'domesticated' sequences," Mol Gen Genomics, 270(2):173-180, (2003).
Sequence Alignment of SDQ ID No. 108 from U.S. Patent Application 2020-0318121; Seq ID 15 Sequence Search Conducted on Dec. 26, 2020, 1 page.
Sequence Alignment of SDQ ID No. 108 from U.S. Patent Application 2020-0318121; Seq ID 16, Sequence Search Conducted on Dec. 26, 2020, 1 page.
Sequence Alignment of SDQ ID No. 256 from U.S. Patent Application 2020-0318135; Seq ID 15, Sequence Search Conducted on Dec. 26, 2020, 1 page.
Sequence Alignment of SDQ ID No. 256 from U.S. Patent Application 2020-0318135; Sequence Search Conducted on Dec. 26, 2020, 1 page.
UnitProt Submission A0A2A4J0M2_Helvi, Uncharacterized protein from Heliothis virescans (Tobacco budworm moth) ORF Names: B5V51_9400, Dec. 20, 2017 [online], retrieved on Jul. 31, 2020, from internet: www.uniprot.org/uniprot/A0A2A4J0M2.
UnitProt Submission A0A2A4K028_HELVI, Heliothis virescens (Tobacco budworm moth) DDE_TNP_1_7 domain-containing protein, Dec. 20, 2017 [online], retrieved on Aug. 14, 2020, from internet: www.uniprot.org/uniprot/A0A2A4K028.
UnitProt Submission A0A3B3INT3_ORYLA Oryzias latipes (Japanese rice fish) (Japanses killifish) DDE_Tnp_1_7 domain-containing protein, Dec. 5, 2018 [online], retrieved on Jul. 31, 2020, from internet: www.uniprot.org/uniprot/A0A3B3INT3.
Wang et al., "Large diversity of the piggyBac-like elements in the genome of Tribolium castaneum," Insect Biochem Mol Biol, 38(4):490-498, doi: 10.1016/j.ibmb.2007.04.012, (2008).
Wang et al., "piggyBac-like elements in the tobacco budworm, Heliothis virescens (Fabricius)," Insect Molecular Biology, 15(4):435-443, (2006).
Wu et al., "An active piggyBac-like element in Macdunnoughia crassisigna," Insect Science, 15:521-528, (2008).
Wu et.al., "Cloning and characterization of piggyBac-like elements in lepidopteran insects," Genetica, 139:149-154, (2011).
Xu et al., "Identification and characteriztion of piggyBac-like elements in the genome of domesticated silkworm, Bombyx mori," Mol Gen Genomics, 276:31-40, (2006).
Zimowska et al., "Highly conserved piggyBac elements in noctuid species of Lepidoptera," Insect Biochemistry and Molecular Biology, 36:421-428, (2006).
U.S. Appl. No. 16/842,707, Non-Final Office Action dated Dec. 31, 2020.
U.S. Appl. No. 16/842,707, Requirement for Restriction/Election dated Oct. 9, 2020.
U.S. Appl. No. 16/842,709, Non-Final Office Action dated Jan. 6, 2021.
U.S. Appl. No. 16/842,709, Requirement for Restriction/Election dated Sep. 28, 2020.
WIPO Application No. PCT/US2020/027077, Invitation To Pay Addistional Fees dated Jul. 9, 2020.
WIPO Application No. PCT/US2020/027077, PCT International Search Report and Written Opinion of the International Searching Authority dated Sep. 4, 2020.
WIPO Application No. PCT/US2020/027078, Invitation To Pay Additional Fees dated Jul. 9, 2020.
WIPO Application No. PCT/US2020/027078, PCT International Search Report and Written Opinion of the International Searching Authority dated Sep. 4, 2020.
WIPO Application No. PCT/US2020/027080, Invitation To Pay Additional Fees dated Jul. 14, 2020.
WIPO Application No. PCT/US2020/027080, PCT International Search Report and Written Opinion of the International Searching Authority dated Sep. 4, 2020.
NCBI References Sequence: XP 013190765.1, Predicted: piggyBac transposable element-derived protein 4-like [Amyelois transitella], BioProject: PRJNA292025, Aug. 6, 2015, retrieved @: www.ncbi.nlm.nih.gov/protein/XP_013190765.1.
NCBI References Sequence: XP 013197997.1; Predicted: piggyBac transposable element-derived protein 4-like [Amyelois transitella], BioProject: PRJNA292025, Aug. 6, 2015, retrieved @: www.ncbi.nlm.nih.gov/protein/XP_03139799.1.

* cited by examiner

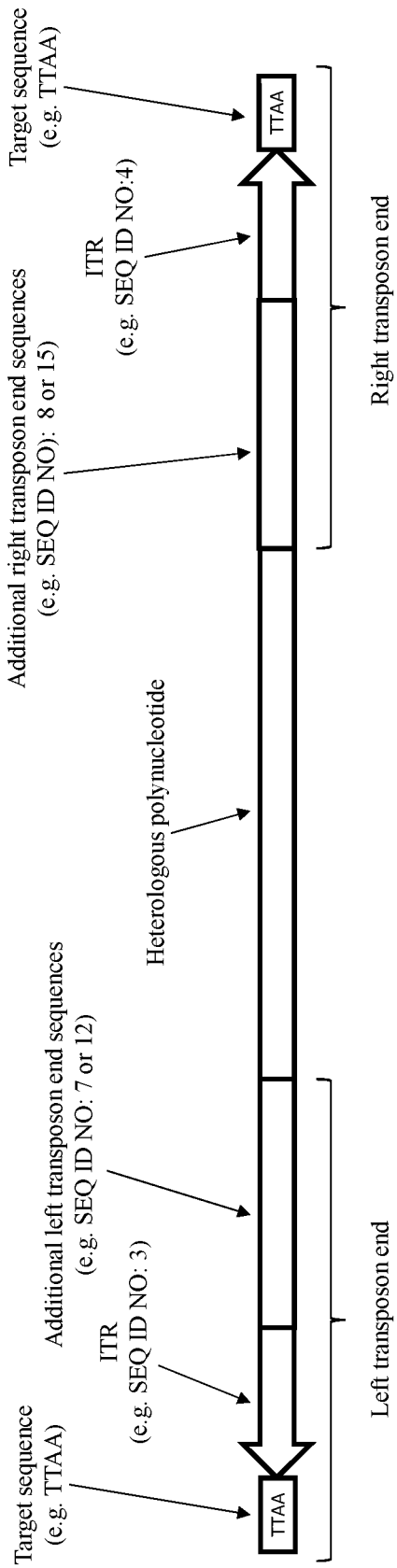

INTEGRATION OF NUCLEIC ACID CONSTRUCTS INTO EUKARYOTIC CELLS WITH A TRANSPOSASE FROM ORYZIAS

CROSS REFERENCE TO RELATED APPLICATIONS

The present application claims priority to U.S. Provisional Application No. 62/831,092 filed Apr. 8, 2019; U.S. Provisional Application No. 62/873,338 filed Jul. 12, 2019; and U.S. Provisional Application No. 62/982,186 filed Feb. 27, 2020, each incorporated by reference in its entirety for all purposes.

REFERENCE TO A SEQUENCE LISTING

The application refers to sequences disclosed in a txt file named 546904SEQLST.TXT, of 2,254,325 bytes, created Apr. 6, 2020, 2020, incorporated by reference.

2. BACKGROUND OF THE INVENTION

The expression levels of genes encoded on a polynucleotide integrated into the genome of a cell depend on the configuration of sequence elements within the polynucleotide. The efficiency of integration and thus the number of copies of the polynucleotide that are integrated into each genome, and the genomic loci where integration occurs also influence the expression levels of genes encoded on the polynucleotide. The efficiency with which a polynucleotide may be integrated into the genome of a target cell can often be increased by placing the polynucleotide into a transposon.

Transposons comprise two ends that are recognized by a transposase. The transposase acts on the transposon to remove it from one DNA molecule and integrate it into another. The DNA between the two transposon ends is transposed by the transposase along with the transposon ends. Heterologous DNA flanked by a pair of transposon ends, such that it is recognized and transposed by a transposase is referred to herein as a synthetic transposon. Introduction of a synthetic transposon and a corresponding transposase into the nucleus of a eukaryotic cell may result in transposition of the transposon into the genome of the cell. These outcomes are useful because they increase transformation efficiencies and because they can increase expression levels from integrated heterologous DNA. There is thus a need in the art for hyperactive transposases and transposons.

Transposition by a piggyBac-like transposase is perfectly reversible. The transposon is initially integrated at an integration target sequence in a recipient DNA molecule, during which the target sequence becomes duplicated at each end of the transposon inverted terminal repeats (ITRs). Subsequent transposition removes the transposon and restores the recipient DNA to its former sequence, with the target sequence duplication and the transposon removed. However, this is not sufficient to remove a transposon from a genome into which it has been integrated, as it is highly likely that the transposon will be excised from the first integration target sequence but transposed into a second integration target sequence in the genome. Transposases that are deficient for the integration (or transposition) function, on the other hand, can excise the transposon from the first target sequence, but will be unable to integrate into a second target sequence. Integration-deficient transposases are thus useful for reversing the genomic integration of a transposon.

One application for transposases is for the engineering of eukaryotic genomes. Such engineering may require the integration of more than one different polynucleotide into the genome. These integrations may be simultaneous or sequential. When transposition into a genome of a first transposon comprising a first heterologous polynucleotide by a first transposase is followed by transposition into the same genome of a second transposon comprising a second heterologous polynucleotide by a second transposase, it is advantageous that the second transposase not recognize and transpose the first transposon. This is because the location of a polynucleotide sequence within the genome influences the expressibility of genes encoded on said polynucleotide, so transposition of the first transposon to a different chromosomal location by the second transposase could change the expression properties of any genes encoded on the first heterologous polynucleotide. There is therefore a need for a set of transposons and their corresponding transposases in which the transposases within the set recognize and transpose only their corresponding transposons, but not any other transposons in the set.

Since its discovery in 1983, the piggyBac transposon and transposase from the looper moth *Trichoplusia ni* has been widely used for inserting heterologous DNA into the genomes of target cells from many different organisms. The piggyBac system is a particularly valuable transposase system because of. "its activity in a wide range of organisms, its ability to integrate multiple large transgenes with high efficiency, the ability to add domains to the transposase without loss of activity, and excision from the genome without leaving a footprint mutation" (Doherty et al., Hum. Gene Ther. 23, 311-320 (2012), at p. 312, LHC ¶ 2).

The value and versatility of the piggyBac system has inspired significant efforts to identify other active piggyBac-like transposons (commonly referred to as piggyBac-like elements, or PLEs) but these have been largely unsuccessful. "Since piggyBac is one of the most popular transposons used for transgenesis, searching for new active PLEs has attracted lots of attention. However, only a few active PLEs have been reported to date." (Luo et al., BMC Molecular Biology 15, 28 (2014) world wide web biomedcentral.com/1471-2199/15/28. p. 4 of 12, RHC, ¶ 1 "Discussion").

Although there are large numbers of homologs of piggyBac transposons and transposases in sequence databases, few active ones have been identified because the vast majority are inactivated by their hosts to avoid activity deleterious to the hosts as illustrated by the following excerpts: "Related piggyBac transposable elements have been found in plants, fungi and animals, including humans [125], although they are probably inactive due to mutation." (Munoz-Lopez & Garcia-Perez, Current Genomics 11, 115-128 (2010) at p. 120, RHC, ¶ 1). "It is believed that transposons invade a genome and subsequently spread throughout it during evolution. The "selfish" mobility of transposons is harmful to the host; hence, they are eliminated or inactivated by the host through natural selection. Even harmless transposons lose the activity eventually because of the absence of conservative selection for them. Thus, in general, transposons have a short life span in a host and they subsequently become fossils in the genome." (Hikosaka et al., Mol. Biol. Evol. 24, 2648-3656 (2007) at p. 2648, LHC, ¶ 1 "Introduction"). "Frequent movement of transposable elements in a genome is harmful (Belancio et al., 2008; Deininger & Batzer, 1999; Le Rouzic & Capy, 2006; Oliver & Greene, 2009). As a result, most transposable elements are inactivated shortly after they invade a new host." (Luo et al., Insect Science 18, 652-662 (2011) at p. 660, LHC, ¶ 1).

Three classes of piggyBac-like elements have been found: (1) those that are very similar to the original piggyBac from the looper moth (typically >95% identical at the nucleotide level), (2) those that are moderately related (typically 30-50% identical at the amino acid level), and (3) those that are very distantly related (Wu et al., Insect Science 15, 521-528 (2008) at p. 521, RHC. ¶ 2).

PiggyBac-like transposases highly related to the looper moth transposase have been described by several groups. They are extremely highly conserved. Very similar transposase sequences to the original piggyBac (95-98% nucleotide identity) have been reported in three different strains of the fruit fly *Bactrocera dorsalis* (Handler & McCombs, Insect Molecular Biology 9, 605-612, (2000)). Comparably conserved piggyBac sequences have been found in other *Bactrocera* species (Bonizzoni et al., Insect Molecular Biology 16, 645-650 (2007)). Two species of noctuid moth (*Helicoverpa zea* and *Helicoverpa armigera*) and other strains of the looper moth *Trichoplusia ni* had genomic copies of the piggyBac transposase with 93-100% nucleotide identity to the original piggyBac sequence (Zimowska & Handler, Insect Biochemistry and Molecular Biology, 36, 421-428 (2006)). Zimowska & Handler also found multiple copies of much more significantly mutated (and truncated) versions of the piggyBac transposase in both *Helicoverpa* species, as well as a homolog in the armyworm *Spodptera frugiperda*. None of these groups attempted to measure any activity for these transposases. Wu et. al (2008), supra, reported isolating a transposase from *Macdunnoughia crassisigna* with 99.5% sequence identity with the looper moth piggyBac. They also demonstrated that this transposon and transposase are active, by showing that they could measure both excision and transposition. Their Discussion summarized previous results as follows: "Other reportedly closely related IFP2 class sequences were in various *Bactrocera* species, *T. ni* genome, Heliocoverpa *armigera*, and *H. zea* (Handler & McCombs, 2000; Zimowska & Handler, 2006; Bonizzoni et al., 2007). These sequences were partial fragments of piggyBac-like elements, and most of them were truncated or inactivated by accumulating random mutations." (Wu et. al., Insect Science 15, 521-528 (2008) at p. 526, LHC, ¶ 3.)

It has proved very difficult to identify active piggyBac-like transposases that are moderately related to the looper moth enzyme simply by looking at sequence. The presence of features that are known to be necessary: a full-length open reading frame, catalytic aspartate residues and intact ITRs, has not proven to be predictive of activity. "A large diversity of PLEs in eukaryotes has been documented in a computational analysis of genomic sequence data [citations omitted]. However, few elements were isolated with an intact structure consistent with function, and only the original IFP2 piggyBac has been developed into a vector for routine transgenesis." (Wu et al., Genetica 139, 149-154 (2011), at p. 152, RHC, ¶ 2.). Wu et al.'s group from Nanjing University (the "Nanjing group") published several papers over a 6-year period, each identifying moderately related piggyBac homologs. Although the Nanjing group showed in 2008 that they could measure both excision and transposition of the *Macdunnoughia crassisigna* transposon by its corresponding transposase, and in each subsequent paper they express the desire to identify novel active piggyBac-like transposases, they only show excision activity and that only for one transposase from *Aphis gossypii*. They conclude that the usefulness of this transposase "remains to be explored with further experiments" (Luo et. al. 2011, p. 660, LHC ¶ 2 "Discussion"). However, none of the other papers published by the Nanjing group in which piggyBac-like sequences were identified from a variety of other insects, show that any activity was found. Three papers identifying other putative active piggyBac-like transposases were published by a group at Kansas State University. None of these papers reports any activity data. Wang et al., Insect Molecular Biology 15, 435-443 (2006) found multiple copies of piggyBac-like sequences in the genome of the tobacco budworm *Heliothis virescens*. Many of these had obvious mutations or deletions that led the authors not to consider them to be candidate active transposases. Wang et. al., Insect Biochemistry and Molecular Biology 38, 490-498 (2008) reported more than 30 piggyBac-like sequences in the genome of the red flour beetle *Tribolium castaneum*. They concluded "All the TcPLEs identified here, except TcPLE1, were apparently defective due to the presence of multiple stop codons and/or indels in the putative transposase encoding regions." Even for TcPLE1 there was "no evidence supporting recent or current mobilization events" (p. 492, section 3.1, ¶ ¶ 2&3). Wang et al. (2010) used PCR to identify piggyBac-like sequences from the pink bollworm *Pectinophora gossypiella*. Again, they found many obviously defective copies, as well as one transposase with characteristics the authors believe to be consistent with activity (page 179, RHC, ¶ 2). But no follow up report indicating transposase activity can be found. Other groups have also attempted to identify active piggyBac-like transposases. These reports conclude with statements that the piggyBac-like elements identified are undergoing testing for activity, but there are no subsequent reports of success. For example, Sarkar et. al. (2003) conclude their Discussion by re-stating the value of novel active piggyBac-like transposons, and describing their ongoing efforts to identify one: "The mobility of the original *T. ni* piggyBac element in various insects suggests that piggyBac family transposons might prove to be useful genetic tools in organisms other than insects. We are currently isolating an intact piggyBac element from An. gambiae (AgaPB1) to test its mobility in various organisms." (Mol. Gen. Genomics 270, 173-180 at p. 179, LHC, ¶ 1). There appear to be no further published reports of this putative active transposase. Xu et al. analyzed the silkworm genome looking for piggyBac-like sequences (Xu et al., Mol Gen Genomics 276, 31-40 (2006)). They found 98 piggyBac-like sequences and performed various computational analyses of putative transposase sequence and ITR sequences. They conclude: "We have isolated several intact piggyBac-like elements from *B. mori* and are currently testing their activity and the feasibility of using them as transformation vectors." (p 38, RHC, ¶ 3). There appear to be no further published reports of these putative active transposases.

Four published papers discussing the third class of distantly related piggyBac-like transposases. The first three of these demonstrate only the excision part of the reaction and acknowledge that this is different from full transposition. Hikosaka et. al., Mol Biol Evol 24, 2648-2656 (2007) reported that "In the present study, we demonstrated that the Xtr-Uribo2 Tpase has excision activity toward the target transposon, although there is no evidence for the integration of the excised target into the genome thus far." (page 2654, RHC, ¶ 2). Luo et. al., Insect Science 18, 652-662 (2011) reported "These results demonstrated the activity of the Ago-PLE1.1 transposase in mediating the first step of the cut and-paste movement of the element" (page 658, LHC, ¶ 1).

Daimon et. al., Genome 53, 585-593 (2010) discussed the transposase systems yabusabe-1 and yabusabe-W. Although Daimon et al. reported detecting an excision event by PCR, they also report screening approximately 100,000 recovered plasmids for the excision of yabusame-1 and yabusame-W without identifying a single recovered plasmid from which the elements had excised. By contrast Daimon reports the transposition frequency of wildtype piggyBac enzyme as around 0.3-1.4. Thus, it appears from Daimon et al. that the excision frequency of yabusabe-1 or —W is less than 0.001% (1:100,000). This is at least 2-3 orders of magnitude less than can be achieved with a wild-type piggyBac enzyme and even less than available genetically engineered variants of piggyBac transposase, which achieve ten-fold higher transposition than wildtype. The implied transposition frequency for yabasume-1 from Daimon et al. is also two orders of magnitude lower than random integration frequency in mammalian cells (which is of the order of 0.1%). Thus, Daimon et al. show that yabusame-1 was essentially inactive and would not be useful as a genetic engineering tool. Such a view likely underlies Daimon et al.'s own conclusion: "Although we could detect the excision event in the highly sensitive PCR-based assay, our data indicate that both elements have lost their excision activity almost entirely." This also suggests that the PCR-based excision assay used to show activity of Uribo2 and Ago-PLE1.1 is not predictive of transposition activity that will be useful for inserting heterologous DNA into the genome of a target cell. The only report of a fully active piggyBac-like transposase (competent for both excision and integration) of the third category of distantly related transposases to the original piggyBac transposase from *Trichoplusia Ni* is one from the bat *Myotis lucifugus* (Mitra et. al., Proc. Natl. Acad. Sci. 110, 234-239 (2013)). These authors used a yeast system to demonstrate both excision and transposition activities for the bat transposase. All of the work described here shows that it has been extremely difficult to identify fully active piggyBac-like transposases, even though there are a large number of candidate sequences. There is therefore a need for new piggyBac-like transposons and their corresponding transposases.

3. SUMMARY OF THE INVENTION

Heterologous gene expression from polynucleotide constructs that stably integrate into a target cell genome can be improved by placing the expression polynucleotide between a pair of transposon ends: sequence elements that are recognized and transposed by transposases. DNA sequences inserted between a pair of transposon ends can be excised by a transposase from one DNA molecule and inserted into a second DNA molecule. A novel piggyBac-like transposon-transposase system is disclosed that is not derived from the looper moth *Trichoplusia ni*. It is derived from the rice fish *Oryzias latipes* (the *Oryzias* transposase and the *Oryzias* transposon). The *Oryzias* transposon comprises sequences that function as transposon ends and that can be used in conjunction with a corresponding *Oryzias* transposase that recognizes and acts on those transposon ends, as a gene transfer system for stably introducing nucleic acids into the DNA of a cell. The gene transfer systems of the invention can be used in methods including but not limited to genomic engineering of eukaryotic cells, heterologous gene expression, gene therapy, cell therapy, insertional mutagenesis, or gene discovery.

Transposition may be effected using a polynucleotide comprising an open reading frame encoding an *Oryzias* transposase, the amino acid sequence of which is at least 90% identical to SEQ ID NO: 782, operably linked to a heterologous promoter. The heterologous promoter may be active in a eukaryotic cell. The heterologous promoter may be active in a mammalian cell. mRNA may be prepared from a polynucleotide comprising an open reading frame encoding an *Oryzias* transposase, the amino acid sequence of which is at least 90% identical to SEQ ID NO: 782, operably linked to a heterologous promoter that is active in an in vitro transcription reaction. The transposase may comprise a mutation as shown in columns C and D in Table 1, relative to the sequence of SEQ ID NO: 782. The transposase may comprise a mutation at an amino acid position selected from 22, 124, 131, 138, 149, 156, 160, 164, 167, 171, 175, 177, 202, 206, 210, 214, 253, 258, 281, 284, 361, 386, 400, 408, 409, 455, 458, 467, 468, 514, 515, 524, 548, 549, 550 and 551, relative to the sequence of SEQ ID NO: 782. The transposase may comprise a mutation selected from E22D, A124C, Q131D, L138V, F149R, L156T, D160E, Y164F, I167L, A171T, R175K, K177N, T202R, I206L, I210L, N214D, V253I, V258L, I281F, A284L, L361I, V386I, M400L, S408E, L409I, F455Y, V458L, V467I, L468I, A514R, V515I, S524P, R548K, D549K, D550R and S551R, relative to the sequence of SEQ ID NO: 782, the transposase optionally including at least 2, 3, 4, or 5 selected from the group. The amino acid sequence of the transposase may be selected from SEQ ID NO: 782 or 805-908. The transposase can excise or transpose a transposon from SEQ ID NO: 41. The excision activity or transposition activity of the transposase is at least 5% or 10% of the activity of SEQ ID NO: 782. Codons of the open reading frame of the transposase may be selected for mammalian cell expression. An isolated mRNA may encode a polypeptide, the amino acid sequence of which is at least 90% identical with SEQ ID NO: 782, and wherein the mRNA sequence comprises at least 10 synonymous codon differences relative to SEQ ID NO: 781 at corresponding positions between the mRNA and SEQ ID NO:781, optionally wherein codons in the mRNA at the corresponding positions are selected for mammalian cell expression. The open reading frame encoding the transposase may further encode a heterologous nuclear localization sequence fused to the transposase. The open reading frame encoding the transposase may further encode a heterologous DNA binding domain (for example derived from a Crispr Cas system, or a zinc finger protein, or a TALE protein) fused to the transposase. A non-naturally occurring polynucleotide may encode a polypeptide, the sequence of which is at least 90% identical to SEQ ID NO: 782.

An *Oryzias* transposon comprises SEQ ID NO: 7 and SEQ ID NO: 8 flanking a heterologous polynucleotide. The transposon may further comprise a sequence at least 90% identical to SEQ ID NO: 12 on one side of the heterologous polynucleotide and a sequence at least 90% identical to SEQ ID NO: 15 on the other. The heterologous polynucleotide may comprise a heterologous promoter that is active in eukaryotic cells. The promoter may be operably linked to at least one or more of: i) an open reading frame; ii) a nucleic acid encoding a selectable marker; iii) a nucleic acid encoding a counter-selectable marker; iii) a nucleic acid encoding a regulatory protein; iv) a nucleic acid encoding an inhibitory RNA. The heterologous promoter may comprise a sequence selected from SEQ ID NOs: 325-409. The heterologous polynucleotide may comprise a heterologous enhancer that is active in eukaryotic cells. The heterologous enhancer may be selected from SEQ ID NOs: 304-324. The heterologous polynucleotide may comprise a heterologous intron that is spliceable in eukaryotic cells. The nucleotide sequence of the heterologous intron may be selected from SEQ ID NO: 412-472. The heterologous polynucleotide may comprise an insulator sequence. The nucleic acid sequence of the insulator may be selected from SEQ ID NO: 286-292. The heterologous polynucleotide may comprise two open reading frames, each operably linked to a separate promoter. The heterologous polynucleotide may comprise a sequence selected from SEQ ID NOs: 596-779. The heterologous polynucleotide may comprise or encode a selectable marker. The selectable marker may be selected from a glutamine synthetase enzyme, a dihydrofolate reductase enzyme, a puromycin acetyltransferase enzyme, a blasticidin acetyltransferase enzyme, a hygromycin B phosphotransferase enzyme, an aminoglycoside 3-phosphotransferase enzyme and a fluorescent protein. A eukaryotic cell whose genome comprises SEQ ID NO: 7 and SEQ ID NO: 8 flanking a heterologous polynucleotide is an embodiment of the invention. The cell may be an animal cell, a mammalian cell, a rodent cell or a human cell.

A transposon may be integrated into the genome of a eukaryotic cell by (a) introducing into the cell a transposon comprising SEQ ID NO: 7 and SEQ ID NO: 8 flanking a heterologous polynucleotide, (b) introducing into the cell a transposase, the sequence of which is at least 90% identical with SEQ ID NO: 782 wherein the transposase transposes the transposon to produce a genome comprising SEQ ID NO: 7 and SEQ ID NO: 8 flanking the heterologous polynucleotide. The transposase may be introduced as a polynucleotide encoding the transposase, the polynucleotide may be an mRNA molecule or a DNA molecule. The transposase may be introduced as a protein. The heterologous polynucleotide may also encode a selectable marker, and the method may further comprise selecting a cell comprising the selectable marker. The cell may be an animal cell, a mammalian cell, a rodent cell or a human cell. The human cell may be a human immune cell, for example a B-cell or a T-cell. The heterologous polynucleotide may encode a chimeric antigen receptor. A polypeptide may be expressed from the transposon integrated into the genome of the eukaryotic cell. The polypeptide may be purified. The purified polypeptide may be incorporated into a pharmaceutical composition.

4. BRIEF DESCRIPTION OF THE FIGURES

FIG. 1. Structure of an *Oryzias* transposon. An *Oryzias* transposon comprises a left transposon end and a right transposon end flanking a heterologous polynucleotide. The left transposon end comprises (i) a left target sequence, which is often 5'-TTAA-3', although a number of other target sequences are used at lower frequency (Li et al., 2013. Proc. Natl. Acad. Sci vol. 110, no. 6, E478-487); (ii) a left ITR (e.g. SEQ ID NO: 7) and (iii) (optionally) additional left transposon end sequences (e.g. SEQ ID NO: 12). The right transposon end comprises (i) (optionally) additional right transposon end sequences (e.g. SEQ ID NO: 15); (ii) a right ITR (e.g. SEQ ID NO: 8) which is a perfect or imperfect repeat of the left ITR, but in inverted orientation relative to the left ITR and (iii) a right target sequence which is typically the same as the left target sequence.

5. DETAILED DESCRIPTION OF THE INVENTION

5.1 Definitions

Use of the singular forms "a," "an," and "the" include plural references unless the context clearly dictates otherwise. Thus, for example, reference to "a polynucleotide" includes a plurality of polynucleotides, reference to "a substrate" includes a plurality of such substrates, reference to "a variant" includes a plurality of variants, and the like.

Terms such as "connected," "attached," "linked," and "conjugated" are used interchangeably herein and encompass direct as well as indirect connection, attachment, linkage or conjugation unless the context clearly dictates otherwise. Where a range of values is recited, it is to be understood that each intervening integer value, and each fraction thereof, between the recited upper and lower limits of that range is also specifically disclosed, along with each subrange between such values. The upper and lower limits of any range can independently be included in or excluded from the range, and each range where either, neither or both limits are included is also encompassed within the invention. Where a value being discussed has inherent limits, for example where a component can be present at a concentration of from 0 to 100%, or where the pH of an aqueous solution can range from 1 to 14, those inherent limits are specifically disclosed. Where a value is explicitly recited, it is to be understood that values which are about the same quantity or amount as the recited value are also within the scope of the invention. Where a combination is disclosed, each sub combination of the elements of that combination is also specifically disclosed and is within the scope of the invention. Conversely, where different elements or groups of elements are individually disclosed, combinations thereof are also disclosed. Where any element of an invention is disclosed as having a plurality of alternatives, examples of that invention in which each alternative is excluded singly or in any combination with the other alternatives are also hereby disclosed; more than one element of an invention can have such exclusions, and all combinations of elements having such exclusions are hereby disclosed.

Unless defined otherwise herein, all technical and scientific terms used herein have the same meaning as commonly understood by one of ordinary skill in the art to which this invention belongs. Singleton, et al., *Dictionary of Microbiology and Molecular Biology*, 2nd Ed., John Wiley and Sons, New York (1994), and Hale & Marham, *The Harper Collins Dictionary of Biology*, Harper Perennial, N Y, 1991, provide one of skill with a general dictionary of many of the terms used in this invention. Although any methods and materials similar or equivalent to those described herein can be used in the practice or testing of the present invention, the preferred methods and materials are described. Unless otherwise indicated, nucleic acids are written left to right in 5' to 3' orientation; amino acid sequences are written left to right in amino to carboxy orientation, respectively. The terms defined immediately below are more fully defined by reference to the specification as a whole.

The "configuration" of a polynucleotide means the functional sequence elements within the polynucleotide, and the order and direction of those elements.

The terms "corresponding transposon" and "corresponding transposase" are used to indicate an activity relationship between a transposase and a transposon. A transposase transposes its corresponding transposon. Many transposases may correspond with a single transposon. A transposon is transposed by its corresponding transposase. Many transposons may correspond with a single transposase.

The term "counter-selectable marker" means a polynucleotide sequence that confers a selective disadvantage on a host cell. Examples of counter-selectable markers include sacB, rpsL, tetAR, pheS, thyA, gata-1, ccdB, kid and barnase (Bernard, 1995, Journal/Gene, 162: 159-160; Bernard et al., 1994. Journal/Gene, 148: 71-74; Gabant et al., 1997, Journal/Biotechniques, 23: 938-941; Gababt et al., 1998, Journal/Gene, 207: 87-92; Gababt et al., 2000, Journal/Biotechniques, 28: 784-788; Galvao and de Lorenzo, 2005, Journal/Appl Environ Microbiol, 71: 883-892; Hartzog et al., 2005, Journal/Yeast, 22:789-798; Knipfer et al., 1997, Journal/Plasmid, 37: 129-140; Reyrat et al., 1998, Journal/Infect Immun, 66: 4011-4017; Soderholm et al., 2001, Journal/Biotechniques, 31: 306-310, 312; Tamura et al., 2005, Journal/Appl Environ Microbiol, 71: 587-590; Yazynin et al., 1999, Journal/FEBS Lett, 452: 351-354). Counter-selectable markers often confer their selective disadvantage in specific contexts. For example, they may confer sensitivity to compounds that can be added to the environment of the host cell, or they may kill a host with one genotype but not kill a host with a different genotype. Conditions which do not confer a selective disadvantage on a cell carrying a counter-selectable marker are described as "permissive". Conditions which do confer a selective disadvantage on a cell carrying a counter-selectable marker are described as "restrictive".

The term "coupling element" or "translational coupling element" means a DNA sequence that allows the expression of a first polypeptide to be linked to the expression of a second polypeptide. Internal ribosome entry site elements (IRES elements) and cis-acting hydrolase elements (CHYSEL elements) are examples of coupling elements.

The terms "DNA sequence", "RNA sequence" or "polynucleotide sequence" mean a contiguous nucleic acid sequence. The sequence can be an oligonucleotide of 2 to 20 nucleotides in length to a full length genomic sequence of thousands or hundreds of thousands of base pairs.

The term "expression construct" means any polynucleotide designed to transcribe an RNA. For example, a construct that contains at least one promoter which is or may be operably linked to a downstream gene, coding region, or polynucleotide sequence (for example, a cDNA or genomic DNA fragment that encodes a polypeptide or protein, or an RNA effector molecule, for example, an antisense RNA, triplex-forming RNA, ribozyme, an artificially selected high affinity RNA ligand (aptamer), a double-stranded RNA, for example, an RNA molecule comprising a stem-loop or hairpin dsRNA, or a bi-finger or multi-finger dsRNA or a microRNA, or any RNA). An "expression vector" is a polynucleotide comprising a promoter which can be operably linked to a second polynucleotide. Transfection or transformation of the expression construct into a recipient cell allows the cell to express an RNA effector molecule, polypeptide, or protein encoded by the expression construct. An expression construct may be a genetically engineered plasmid, virus, recombinant virus, or an artificial chromosome derived from, for example, a bacteriophage, adenovirus, adeno-associated virus, retrovirus, lentivirus, poxvirus, or herpesvirus. Such expression vectors can include sequences from bacteria, viruses or phages. Such vectors include chromosomal, episomal and virus-derived vectors, for example, vectors derived from bacterial plasmids, bacteriophages, yeast episomes, yeast chromosomal elements, and viruses, vectors derived from combinations thereof, such as those derived from plasmid and bacteriophage genetic elements, cosmids and phagemids. An expression construct can be replicated in a living cell, or it can be made synthetically. For purposes of this application, the terms "expression construct", "expression vector", "vector", and "plasmid" are used interchangeably to demonstrate the application of the invention in a general, illustrative sense, and are not intended to limit the invention to a particular type of expression construct.

The term "expression polypeptide" means a polypeptide encoded by a gene on an expression construct.

The term "expression system" means any in vivo or in vitro biological system that is used to produce one or more gene product encoded by a polynucleotide.

A "gene" refers to a transcriptional unit including a promoter and sequence to be expressed from it as an RNA or protein. The sequence to be expressed can be genomic or cDNA among other possibilities. Other elements, such as introns, and other regulatory sequences may or may not be present.

A "gene transfer system" comprises a vector or gene transfer vector, or a polynucleotide comprising the gene to be transferred which is cloned into a vector (a "gene transfer polynucleotide" or "gene transfer construct"). A gene transfer system may also comprise other features to facilitate the process of gene transfer. For example, a gene transfer system may comprise a vector and a lipid or viral packaging mix for enabling a first polynucleotide to enter a cell, or it may comprise a polynucleotide that includes a transposon and a second polynucleotide sequence encoding a corresponding transposase to enhance productive genomic integration of the transposon. The transposases and transposons of a gene transfer system may be on the same nucleic acid molecule or on different nucleic acid molecules. The transposase of a gene transfer system may be provided as a polynucleotide or as a polypeptide.

Two elements are "heterologous" to one another if not naturally associated. For example, a nucleic acid sequence encoding a protein linked to a heterologous promoter means a promoter other than that which naturally drives expression of the protein. A heterologous nucleic acid flanked by transposon ends or ITRs means a heterologous nucleic acid not naturally flanked by those transposon ends or ITRs, such as a nucleic acid encoding a polypeptide other than a transposase, including an antibody heavy or light chain. A nucleic acid is heterologous to a cell if not naturally found in the cell or if naturally found in the cell but in a different location (e.g., episomal or different genomic location) than the location described.

The term "host" means any prokaryotic or eukaryotic organism that can be a recipient of a nucleic acid. A "host," as the term is used herein, includes prokaryotic or eukaryotic organisms that can be genetically engineered. For examples of such hosts, see Maniatis et al., Molecular Cloning. A Laboratory Manual, Cold Spring Harbor Laboratory, Cold Spring Harbor, N.Y. (1982). As used herein, the terms "host," "host cell," "host system" and "expression host" can be used interchangeably.

A "hyperactive" transposase is a transposase that is more active than the naturally occurring transposase from which it is derived. "Hyperactive" transposases are thus not naturally occurring sequences.

'Integration defective' or "transposition defective" means a transposase that can excise its corresponding transposon, but that integrates the excised transposon at a lower frequency into the host genome than a corresponding naturally occurring transposase.

An "IRES" or "internal ribosome entry site" means a specialized sequence that directly promotes ribosome binding, independent of a cap structure.

An 'isolated' polypeptide or polynucleotide means a polypeptide or polynucleotide that has been either removed from its natural environment, produced using recombinant techniques, or chemically or enzymatically synthesized. Polypeptides or polynucleotides of this invention may be purified, that is, essentially free from any other polypeptide or polynucleotide and associated cellular products or other impurities.

The terms "nucleoside" and "nucleotide" include those moieties which contain not only the known purine and pyrimidine bases, but also other heterocyclic bases which have been modified. Such modifications include methylated purines or pyrimidines, acylated purines or pyrimidines, or other heterocycles. Modified nucleosides or nucleotides can also include modifications on the sugar moiety, for example, where one or more of the hydroxyl groups are replaced with halogen, aliphatic groups, or is functionalized as ethers, amines, or the like. The term "nucleotidic unit" is intended to encompass nucleosides and nucleotides.

An "Open Reading Frame" or "ORF" means a portion of a polynucleotide that, when translated into amino acids, contains no stop codons. The genetic code reads DNA sequences in groups of three base pairs, which means that a double-stranded DNA molecule can read in any of six possible reading frames-three in the forward direction and three in the reverse. An ORF typically also includes an initiation codon at which translation may start.

The term "operably linked" refers to functional linkage between two sequences such that one sequence modifies the behavior of the other. For example, a first polynucleotide comprising a nucleic acid expression control sequence (such as a promoter, IRES sequence, enhancer or array of transcription factor binding sites) and a second polynucleotide are operably linked if the first polynucleotide affects transcription and/or translation of the second polynucleotide. Similarly, a first amino acid sequence comprising a secretion signal or a subcellular localization signal and a second amino acid sequence are operably linked if the first amino acid sequence causes the second amino acid sequence to be secreted or localized to a subcellular location.

The term "orthogonal" refers to a lack of interaction between two systems. A first transposon and its corresponding first transposase and a second transposon and its corresponding second transposase are orthogonal if the first transposase does not excise or transpose the second transposon and the second transposase does not excise or transpose the first transposon.

The term "overhang" or "DNA overhang" means the single-stranded portion at the end of a double-stranded DNA molecule. Complementary overhangs are those which will base-pair with each other.

A "piggyBac-like transposase" means a transposase with at least 20% sequence identity as identified using the TBLASTN algorithm to the piggyBac transposase from *Trichoplusia ni* (SEQ ID NO: 909) and as more fully described in Sakar, A. et. al., (2003). Mol. Gen. Genomics 270: 173-180. "Molecular evolutionary analysis of the widespread piggyBac transposon family and related 'domesticated' species", and further characterized by a DDE-like DDD motif, with aspartate residues at positions corresponding to D268, D346, and D447 of *Trichoplusia ni* piggyBac transposase on maximal alignment. PiggyBac-like transposases are also characterized by their ability to excise their transposons precisely with a high frequency. A "piggyBac-like transposon" means a transposon having transposon ends which are the same or at least 80% and preferably at least 90, 95, 96, 97, 98 or 99% or 100% identical to the transposon ends of a naturally occurring transposon that encodes a piggyBac-like transposase. A piggyBac-like transposon includes an inverted terminal repeat (ITR) sequence of approximately 12-16 bases at each end, and is flanked on each side by a 4 base sequence corresponding to the integration target sequence which is duplicated on transposon integration (the Target Site Duplication or Target Sequence Duplication or TSD). PiggyBac-like transposons and transposases occur naturally in a wide range of organisms including *Argyrogramma agnate* (GU477713), *Anopheles gambiae* (XP_312615; XP_320414; XP_310729), *Aphis gossypii* (GU329918), *Acyrthosiphon pisum* (XP_001948139), *Agrotis ipsilon* (GU477714), *Bombyx mori* (BAD11135), *Ciona intestinalis* (XP_002123602), *Chilo suppressalis* (JX294476), *Drosophila melanogaster* (AAL39784), *Daphnia pulicaria* (AAM76342), *Helicoverpa armigera* (ABS18391), *Homo sapiens* (NP_689808), *Heliothis virescens* (ABD76335), *Macdunnoughia crassisigna* (EU287451), *Macaca fascicularis* (AB179012), *Mus musculus* (NP_741958), *Pectinophora gossypiella* (GU270322), *Rattus norvegicus* (XP_220453), *Tribolium castaneum* (XP_001814566) and *Trichoplusia ni* (AAA87375) and *Xenopus tropicalis* (BAF82026), although transposition activity has been described for almost none of these.

The terms "polynucleotide," "oligonucleotide," "nucleic acid" and "nucleic acid molecule" are used interchangeably to refer to a polymeric form of nucleotides of any length, and may comprise ribonucleotides, deoxyribonucleotides, analogs thereof, or mixtures thereof. This term refers only to the primary structure of the molecule. Thus, the term includes triple-, double- and single-stranded deoxyribonucleic acid ("DNA"), as well as triple-, double- and single-stranded ribonucleic acid ("RNA"). It also includes modified, for example by alkylation, and/or by capping, and unmodified forms of the polynucleotide. More particularly, the terms "polynucleotide," "oligonucleotide," "nucleic acid" and "nucleic acid molecule" include polydeoxyribonucleotides (containing 2-deoxy-D-ribose), polyribonucleotides (containing D-ribose), including tRNA, rRNA, hRNA, siRNA and mRNA, whether spliced or unspliced, any other type of polynucleotide which is an N- or C-glycoside of a purine or pyrimidine base, and other polymers containing non-nucleotidic backbones, for example, polyamide (for example, peptide nucleic acids ("PNAs")) and polymorpholino (commercially available from the Anti-Virals, Inc., Corvallis, Oreg., as Neugene) polymers, and other synthetic sequence-specific nucleic acid polymers providing that the polymers contain nucleobases in a configuration which allows for base pairing and base stacking, such as is found in DNA and RNA. There is no intended distinction in length between the terms "polynucleotide," "oligonucleotide," "nucleic acid" and "nucleic acid molecule," and these terms are used interchangeably herein. These terms refer only to the primary structure of the molecule. Thus, these terms include, for example, 3'-deoxy-2', 5'-DNA, oligodeoxyribonucleotide N3' P5'phosphoramidates, 2'-O-alkyl-substituted RNA, double- and single-stranded DNA, as well as double- and single-stranded RNA, and hybrids thereof including for example hybrids between DNA and RNA or between PNAs and DNA or RNA, and also include known types of modifications, for example, labels, alkylation, "caps," substitution of one or more of the nucleotides with an analog, internucleotide modifications such as, for example, those with uncharged linkages (for example, methyl phosphonates, phosphotriesters, phosphoramidates, carbamates, or the like) with negatively charged linkages (for example, phosphorothioates, phosphorodithioates, or the like), and with positively charged linkages (for example, aminoalkylphosphoramidates, aminoalkylphosphotriesters), those containing pendant moieties, such as, for example, proteins (including enzymes (for example, nucleases), toxins, antibodies, signal peptides, poly-L-lysine, or the like), those with intercalators (for example, acridine, psoralen, or the like), those containing chelates (of, for example, metals, radioactive metals, boron, oxidative metals, or the like), those containing alkylators, those with modified linkages (for example, alpha anomeric nucleic acids, or the like), as well as unmodified forms of the polynucleotide or oligonucleotide.

A "promoter" means a nucleic acid sequence sufficient to direct transcription of an operably linked nucleic acid molecule. A promoter can be used with or without other transcription control elements (for example, enhancers) that are sufficient to render promoter-dependent gene expression controllable in a cell type-specific, tissue-specific, or temporal-specific manner, or that are inducible by external signals or agents; such elements, may be within the 3' region of a gene or within an intron. Desirably, a promoter is operably linked to a nucleic acid sequence, for example, a cDNA or a gene sequence, or an effector RNA coding sequence, in such a way as to enable expression of the nucleic acid sequence, or a promoter is provided in an expression cassette into which a selected nucleic acid sequence to be transcribed can be conveniently inserted. A regulatory element such as promoter active in a mammalian cells means a regulatory element configurable to result in a level of expression of at least 1 transcript per cell in a mammalian cell into which the regulatory element has been introduced.

The term "selectable marker" means a polynucleotide segment or expression product thereof that allows one to select for or against a molecule or a cell that contains it, often under particular conditions. These markers can encode an activity, such as, but not limited to, production of RNA, peptide, or protein, or can provide a binding site for RNA, peptides, proteins, inorganic and organic compounds or compositions. Examples of selectable markers include but are not limited to: (1) DNA segments that encode products which provide resistance against otherwise toxic compounds (e.g., antibiotics); (2) DNA segments that encode products which are otherwise lacking in the recipient cell (e.g., tRNA genes, auxotrophic markers); (3) DNA segments that encode products which suppress the activity of a gene product; (4) DNA segments that encode products which can be readily identified (e.g., phenotypic markers such as beta-galactosidase, green fluorescent protein (GFP), and cell surface proteins); (5) DNA segments that bind products which are otherwise detrimental to cell survival and/or function; (6) DNA segments that otherwise inhibit the activity of any of the DNA segments described in Nos. 1-5 above (e.g., antisense oligonucleotides); (7) DNA segments that bind products that modify a substrate (e.g. restriction endonucleases); (8) DNA segments that can be used to isolate a desired molecule (e.g. specific protein binding sites); (9) DNA segments that encode a specific nucleotide sequence which can be otherwise non-functional (e.g., for PCR amplification of subpopulations of molecules); and/or (10) DNA segments, which when absent, directly or indirectly confer sensitivity to particular compounds.

Sequence identity can be determined by aligning sequences using algorithms, such as BESTFIT, FASTA, and TFASTA in the Wisconsin Genetics Software Package Release 7.0, Genetics Computer Group, 575 Science Dr., Madison, Wis.), using default gap parameters, or by inspection, and the best alignment (i.e., resulting in the highest percentage of sequence similarity over a comparison window). Percentage of sequence identity is calculated by comparing two optimally aligned sequences over a window of comparison, determining the number of positions at which the identical residues occurs in both sequences to yield the number of matched positions, dividing the number of matched positions by the total number of matched and mismatched positions not counting gaps in the window of comparison (i.e., the window size), and multiplying the result by 100 to yield the percentage of sequence identity. Unless otherwise indicated the window of comparison between two sequences is defined by the entire length of the shorter of the two sequences.

A "target nucleic acid" is a nucleic acid into which a transposon is to be inserted. Such a target can be part of a chromosome, episome or vector.

An "integration target sequence" or "target sequence" or "target site" for a transposase is a site or sequence in a target DNA molecule into which a transposon can be inserted by a transposase. The piggyBac transposase from *Trichoplusia ni* inserts its transposon predominantly into the target sequence 5'-TTAA-3'. Other useable target sequences for piggyBac transposons are 5'-CTAA-3', 5'-TTAG-3', 5'-ATAA-3', 5'-TCAA-3', 5'-AGTT-3', 5'-ATTA-3', 5'-GTTA-3', 5'-TTGA-3', 5'-TTTA-3', 5'-TTAC-3', 5'-ACTA-3', 5'-AGGG-3', 5'-CTAG-3', 5'-GTAA-3', 5'-AGGT-3', 5'-ATCA-3', 5'-CTCC-3', 5'-TAAA-3', 5'-TCTC-3', 5'-TGAA-3', 5'-AAAT-3', 5'-AATC-3', 5'-ACAA-3', 5'-ACAT-3', 5'-ACTC-3', 5'-AGTG-3', 5'-ATAG-3', 5'-CAAA-3', 5'-CACA-3', 5'-CATA-3', 5'-CCAG-3', 5'-CCCA-3', 5'-CGTA-3', 5'-CTGA-3', 5'-GTCC-3', 5'-TAAG-3', 5'-TCTA-3', 5'-TGAG-3', 5'-TGTT-3', 5'-TTCA-3', 5'-TTCT-3' and 5'-TTTT-3' (Li et al., 2013. Proc. Natl. Acad. Sci vol. 110, no. 6, E478-487). PiggyBac-like transposases transpose their transposons using a cut-and-paste mechanism, which results in duplication of their 4 base pair target sequence on insertion into a DNA molecule. The target sequence is thus found on each side of an integrated piggyBac-like transposon.

The term "translation" refers to the process by which a polypeptide is synthesized by a ribosome 'reading' the sequence of a polynucleotide.

A 'transposase' is a polypeptide that catalyzes the excision of a corresponding transposon from a donor polynucleotide, for example a vector, and (providing the transposase is not integration-deficient) the subsequent integration of the transposon into a target nucleic acid. An "*Oryzias* transposase" means a transposase with at least 80, 90, 95, 96, 97, 98, 99 or 100% sequence identity to SEQ ID NO: 782, including hyperactive variants of SEQ ID NO: 782, that are able to transposase a corresponding transposon. A hyperactive transposase is a transposase that is more active than the naturally occurring transposase from which it is derived, for excision activity or transposition activity or both. A hyperactive transposase is preferably at least 1.5-fold more active, or at least 2-fold more active, or at least 5-fold more active, or at least 10-fold more active than the naturally occurring transposase from which it is derived, e.g., 2-5 fold or 1.5-10 fold. A transposase may or more not be fused to one or more additional domains such as a nuclear localization sequence or DNA binding protein.

The term "transposition" is used herein to mean the action of a transposase in excising a transposon from one polynucleotide and then integrating it, either into a different site in the same polynucleotide, or into a second polynucleotide.

The term "transposon" means a polynucleotide that can be excised from a first polynucleotide, for instance, a vector, and be integrated into a second position in the same polynucleotide, or into a second polynucleotide, for instance, the genomic or extrachromosomal DNA of a cell, by the action of a corresponding trans-acting transposase. A transposon comprises a first transposon end and a second transposon end, which are polynucleotide sequences recognized by and transposed by a transposase. A transposon usually further comprises a first polynucleotide sequence between the two transposon ends, such that the first polynucleotide sequence is transposed along with the two transposon ends by the action of the transposase. This first polynucleotide in natural transposons frequently comprises an open reading frame encoding a corresponding transposase that recognizes and transposes the transposon. Transposons of the present invention are "synthetic transposons" comprising a heterologous polynucleotide sequence which is transposable by virtue of its juxtaposition between two transposon ends. Synthetic transposons may or may not further comprise flanking polynucleotide sequence(s) outside the transposon ends, such as a sequence encoding a transposase, a vector sequence or sequence encoding a selectable marker.

The term "transposon end" means the cis-acting nucleotide sequences that are sufficient for recognition by and transposition by a corresponding transposase. Transposon ends of piggyBac-like transposons comprise perfect or imperfect repeats such that the respective repeats in the two transposon ends are reverse complements of each other. These are referred to as inverted terminal repeats (ITR) or terminal inverted repeats (TIR). A transposon end may or may not include additional sequence proximal to the ITR that promotes or augments transposition.

The term "vector" or "DNA vector" or "gene transfer vector" refers to a polynucleotide that is used to perform a "carrying" function for another polynucleotide. For example, vectors are often used to allow a polynucleotide to be propagated within a living cell, or to allow a polynucleotide to be packaged for delivery into a cell, or to allow a polynucleotide to be integrated into the genomic DNA of a cell. A vector may further comprise additional functional elements, for example it may comprise a transposon.

5.2 Description 5.2.1 Genomic Integration

Expression of a gene from a heterologous polynucleotide in a eukaryotic host cell can be improved if the heterologous polynucleotide is integrated into the genome of the host cell. Integration of a polynucleotide into the genome of a host cell also generally makes it stably heritable, by subjecting it to the same mechanisms that ensure the replication and division of genomic DNA. Such stable heritability is desirable for achieving good and consistent expression over long growth periods. This is particularly important for cell therapies in which cells are genetically modified and then placed into the body. It is also important for the manufacturing of biomolecules, particularly for therapeutic applications where the stability of the host and consistency of expression levels is also important for regulatory purposes. Cells with gene transfer vectors, including transposon-based gene transfer vectors, integrated into their genomes are thus an important embodiment of the invention.

Heterologous polynucleotides may be more efficiently integrated into a target genome if they are part of a transposon (i.e., positioned between transposon ITRs), for example so that they may be integrated by a transposase A particular benefit of a transposon is that the entire polynucleotide between the transposon ITRs is integrated. A transposon comprising target sites flanking ITRs flanking a heterologous polynucleotide integrates at a target site in a genome to result in the genome containing the heterologous polynucleotide flanked by the ITRs, flanked by target sites. This is in contrast to random integration, where a polynucleotide introduced into a eukaryotic cell is often fragmented at random in the cell, and only parts of the polynucleotide become incorporated into the target genome, usually at a low frequency. The piggyBac transposon from the looper moth *Trichoplusia ni* has been shown to be transposed by its transposase in cells from many organisms (see e.g. Keith et al (2008) BMC Molecular Biology 9:72 "Analysis of the piggyBac transposase reveals a functional nuclear targeting signal in the 94 c-terminal residues"). Heterologous polynucleotides incorporated into piggyBac-like transposons may be integrated into eukaryotic cells including animal cells, fungal cells or plant cells. Preferred animal cells can be vertebrate or invertebrate. Preferred vertebrate cells include cells from mammals including rodents such as rats, mice, and hamsters; ungulates, such as cows, goats or sheep; and swine. Preferred vertebrate cells also include cells from human tissues and human stem cells. Target cells types include hepatocytes, neural cells, muscle cells, blood cells, embryonic stem cells, somatic stem cells, hematopoietic cells, embryos, zygotes, sperm cells (some of which are open to be manipulated in an in vitro setting) and immune cells including lymphocytes such as T cells, B cells and natural killer cells, T-helper cells, antigen-presenting cells, dendritic cells, neutrophils and macrophages. Preferred cells can be pluripotent cells (cells whose descendants can differentiate into several restricted cell types, such as hematopoietic stem cells or other stem cells) or totipotent cells (i.e., a cell whose descendants can become any cell type in an organism, e.g., embryonic stem cells). Preferred culture cells are Chinese hamster ovary (CHO) cells or Human embryonic kidney (HEK293) cells. Preferred fungal cells are yeast cells including *Saccharomyces cerevisiae* and *Pichia pastoris*. Preferred plant cells are algae, for example *Chlorella*, tobacco, maize and rice (Nishizawa-Yokoi et al (2014) Plant J. 77:454-63 "Precise marker excision system using an animal derived piggyBac transposon in plants").

Preferred gene transfer systems comprise a transposon in combination with a corresponding transposase protein that transposases the transposon, or a nucleic acid that encodes the corresponding transposase protein and is expressible in the target cell. A preferred gene transfer system comprises a synthetic *Oryzias* transposon and a corresponding *Oryzias* transposase.

A transposase protein can be introduced into a cell as a protein or as a nucleic acid encoding the transposase, for example as a ribonucleic acid, including mRNA or any polynucleotide recognized by the translational machinery of a cell; as DNA, e.g. as extrachromosomal DNA including episomal DNA; as plasmid DNA, or as viral nucleic acid. Furthermore, the nucleic acid encoding the transposase protein can be transfected into a cell as a nucleic acid vector such as a plasmid, or as a gene expression vector, including a viral vector. The nucleic acid can be circular or linear. mRNA encoding the transposase may be prepared using DNA in which a gene encoding the transposase is operably linked to a heterologous promoter, such as the bacterial T7 promoter, which is active in vitro. DNA encoding the transposase protein can be stably inserted into the genome of the cell or into a vector for constitutive or inducible expression. Where the transposase protein is transfected into the cell or inserted into the vector as DNA, the transposase encoding sequence is preferably operably linked to a heterologous promoter. There are a variety of promoters that could be used including constitutive promoters, cell-type specific promoters, organism-specific promoters, tissue-specific promoters, inducible promoters, and the like. Where DNA encoding the transposase is operably linked to a promoter and transfected into a target cell, the promoter should be operable in the target cell. For example if the target cell is a mammalian cell, the promoter should be operable in a mammalian cell; if the target cell is a yeast cell, the promoter should be operable in a yeast cell; if the target cell is an insect cell, the promoter should be operable in an insect cell; if the target cell is a human cell, the promoter should be operable in a human cell; if the target cell is a human immune cell, the promoter should be operable in a human immune cell. All DNA or RNA sequences encoding piggyBac-like transposase proteins are expressly contemplated. Alternatively, the transposase may be introduced into the cell directly as protein, for example using cell-penetrating peptides (e.g. as described in Ramsey and Flynn (2015) Pharmacol. Ther. 154: 78-86 "Cell-penetrating peptides transport therapeutics into cells"); using small molecules including salt plus propanebetaine (e.g. as described in Astolfo et al (2015) Cell 161: 674-690); or electroporation (e.g. as described in Morgan and Day (1995) Methods in Molecular Biology 48: 63-71 "The introduction of proteins into mammalian cells by electroporation").

It is possible to insert the transposon into DNA of a cell through non-homologous recombination through a variety of reproducible mechanisms, and even without the activity of a transposase. The transposons described herein can be used for gene transfer regardless of the mechanisms by which the genes are transferred.

5.2.5 Gene Transfer Systems

Gene transfer systems comprise a polynucleotide to be transferred to a host cell. Preferably the polynucleotide comprises an *Oryzias* transposon and wherein the polynucleotide is to be integrated into the genome of a target cell.

When there are multiple components of a gene transfer system, for example the one or more polynucleotides comprising genes for expression in the target cell and optionally comprising transposon ends, and a transposase (which may be provided either as a protein or encoded by a nucleic acid), these components can be transfected into a cell at the same time, or sequentially. For example, a transposase protein or its encoding nucleic acid may be transfected into a cell prior to, simultaneously with or subsequent to transfection of a corresponding transposon. Additionally, administration of either component of the gene transfer system may occur repeatedly, for example, by administering at least two doses of this component.

Any of the transposase proteins described herein may be encoded by polynucleotides including RNA or DNA. Similarly, the nucleic acid encoding the transposase protein or the transposon of this invention can be transfected into the cell as a linear fragment or as a circularized fragment, either as a plasmid or as recombinant viral DNA.

An *Oryzias* transposase may be provided as a DNA molecule expressible in the target cell. The sequence encoding the *Oryzias* transposase should be operably linked to heterologous sequences that enable expression of the transposase in the target cell. A sequence encoding the *Oryzias* transposase may be operably linked to a heterologous promoter that is active in the target cell. For example, if the target cell is a mammalian cell, then the promoter should be active in a mammalian cell. If the target is a vertebrate cell, the promoter should be active in a vertebrate cell. If the target cell is a plant cell, the promoter should be active in a plant cell. If the promoter is an insect cell, the promoter should be active in an insect cell. The sequence encoding the *Oryzias* transposase may also be operably linked to other sequence elements required for expression in the target cell, for example polyadenylation sequences, terminator sequences etc.

An *Oryzias* transposase may be provided as an mRNA expressible in the target cell. mRNA is preferably prepared in an in vitro transcription reaction. For in vitro transcription, a sequence encoding the *Oryzias* transposase is operably linked to a promoter that is active in an in vitro transcription reaction. Exemplary promoters active in an in vitro transcription reaction include a T7 promoter (5'-TAATACGACTCACTATAG-3') which enables transcription by T7 RNA polymerase, a T3 promoter (5'-AATTAACCCTCACTAAAG-3') which enables transcription by T3 RNA polymerase and an SP6 promoter (5'-ATTTAGGTGACACTATAG-3') which enables transcription by SP6 RNA polymerase. Variants of these promoters and other promoters that can be used for in vitro transcription may also be operably linked to a sequence encoding an *Oryzias* transposase.

If the *Oryzias* transposase is provided as a polynucleotide (either DNA or mRNA) encoding the transposase, then it is advantageous to improve the expressibility of the transposase in the target cell. It is therefore advantageous to use a sequence other than a naturally occurring sequence to encode the transposase, in other words, to use codon-preferences of the cell type in which expression is to be performed. For example, if the target cell is a mammalian cell, then the codons should be biased toward the preferences seen in a mammalian cell. If the target is a vertebrate cell, then the codons should be biased toward the preferences seen in the particular vertebrate cell. If the target cell is a plant cell, then the codons should be biased toward the preferences seen in a in a plant cell. If the promoter is an insect cell, then the codons should be biased toward the preferences seen in an insect cell.

Preferable RNA molecules include those with appropriate cap structures to enhance translation in a eukaryotic cell, polyadenylic acid and other 3' sequences that enhance mRNA stability in a eukaryotic cell and optionally substitutions to reduce toxicity effects on the cell, for example substitution of uridine with pseudouridine, and substitution of cytosine with 5-methyl cytosine. mRNA encoding the *Oryzias* transposase may be prepared such that it has a 5'-cap structure to improve expression in a target cell. Exemplary cap structures are a cap analog (G(5')ppp(5')G), an anti-reverse cap analog (3'-O-Me-m$^7$G(5')ppp(5')G, a clean cap (m7G(5')ppp(5')(2'OMeA)pG), an mCap (m7G(5')ppp(5') G). mRNA encoding the *Oryzias* transposase may be prepared such that some bases are partially or fully substituted, for example uridine may be substituted with pseudo-uridine, cytosine may be substituted with 5-methyl-cytosine. Any combinations of these caps and substitutions may be made.

The components of the gene transfer system may be transfected into one or more cells by techniques such as particle bombardment, electroporation, microinjection, combining the components with lipid-containing vesicles, such as cationic lipid vesicles, DNA condensing reagents (example, calcium phosphate, polylysine or polyethyleneimine), and inserting the components (that is the nucleic acids thereof into a viral vector and contacting the viral vector with the cell. Where a viral vector is used, the viral vector can include any of a variety of viral vectors known in the art including viral vectors selected from the group consisting of a retroviral vector, an adenovirus vector or an adeno-associated viral vector. The gene transfer system may be formulated in a suitable manner as known in the art, or as a pharmaceutical composition or kit.

5.2.3 Sequence Elements in Gene Transfer Systems

Expression of genes from a gene transfer polynucleotide such as a piggyBac-like transposon, including an *Oryzias* transposon, integrated into a host cell genome is often strongly influenced by the chromatin environment into which it integrates. Polynucleotides that are integrated into euchromatin have higher levels of expression than those that are either integrated into heterochromatin, or which become silenced following their integration. Silencing of a heterologous polynucleotide may be reduced if it comprises a chromatin control element. It is thus advantageous for gene transfer polynucleotides (including any of the transposons described herein) to comprise chromatin control elements such as sequences that prevent the spread of heterochromatin (insulators). Advantageous gene transfer polynucleotides including an *Oryzias* transposon comprise an insulator sequence that is at least 95% identical to a sequence selected from one of SEQ ID NOS: 286-292, they may also comprise ubiquitously acting chromatin opening elements (UCOEs) or stabilizing and anti-repressor elements (STARs), to increase long-term stable expression from the integrated gene transfer polynucleotide. Advantageous gene transfer polynucleotides may further comprise a matrix attachment region for example a sequence that is at least 95% identical to a sequence selected from one of SEQ ID NOS: 293-303.

In some cases, it is advantageous for a gene transfer polynucleotide to comprise two insulators, one on each side of the heterologous polynucleotide that contains the sequence(s) to be expressed, and within the transposon ITRs. The insulators may be the same, or they may be different. Particularly advantageous gene transfer polynucleotides comprise an insulator sequence that is at least 95% identical to a sequence selected from one of SEQ ID NO: 291 or SEQ ID NO: 292 and an insulator sequence that is at least 95% identical to a sequence selected from one of SEQ ID NOS: 286-290. Insulators also shield expression control elements from one another. For example, when a gene transfer polynucleotide comprises genes encoding two open reading frames, each operably linked to a different promoter, one promoter may reduce expression from the other in a phenomenon known as transcriptional interference. Interposing an insulator sequence that is at least 95% identical to a sequence selected from one of SEQ ID NOS: 286-292 between the two transcriptional units can reduce this interference, increasing expression from one or both promoters.

Preferred gene transfer vectors comprise expression elements capable of driving high levels of gene expression. In eukaryotic cells, gene expression is regulated by several different classes of elements, including enhancers, promoters, introns, RNA export elements, polyadenylation sequences and transcriptional terminators.

Advantageous gene transfer polynucleotides for the transfer of genes for expression into eukaryotic cells comprise an enhancer operably linked to a heterologous gene. Advantageous gene transfer polynucleotides for the transfer of genes for expression into mammalian cells comprise an enhancer from immediate early genes 1, 2 or 3 of cytomegalovirus (CMV) from either human, primate or rodent cells (for example sequences at least 95% identical to any of SEQ ID NOs: 304-322), an enhancer from the adenoviral major late protein enhancer (for example sequences at least 95% identical to SEQ ID NO: 323), or an enhancer from SV40 (for example sequences at least 95% identical to SEQ ID NO: 324), operably linked to a heterologous gene.

Advantageous gene transfer polynucleotides for the transfer of genes for expression into eukaryotic cells comprise a promoter operably linked to a heterologous gene. Advantageous gene transfer polynucleotides for the transfer of genes for expression into mammalian cells comprise an EF1a promoter from any mammalian or avian species including human, rat, mice, chicken and Chinese hamster, (for example any of SEQ ID NOs: 325-346); a promoter from the immediate early genes 1, 2 or 3 of cytomegalovirus (CMV) from either human, primate or rodent cells (for example any of SEQ ID NOS: 347-357); a promoter for eukaryotic elongation factor 2 (EEF2) from any mammalian or avian species including human, rat, mice, chicken and Chinese hamster, (for example any of SEQ ID NOs: 358-368); a GAPDH promoter from any mammalian or yeast species (for example any of SEQ ID NOs: 379-395), an actin promoter from any mammalian or avian species including human, rat, mice, chicken and Chinese hamster (for example any of SEQ ID NOs: 369-378); a PGK promoter from any mammalian or avian species including human, rat, mice, chicken and Chinese hamster (for example any of SEQ ID NOs: 396-402), or a ubiquitin promoter (for example SEQ ID NO: 403), operably linked to a heterologous gene. The promoter may be operably linked to i) a heterologous open reading frame; ii) a nucleic acid encoding a selectable marker; iii) a nucleic acid encoding a counter-selectable marker; iii) a nucleic acid encoding a regulatory protein; iv) a nucleic acid encoding an inhibitory RNA.

Advantageous gene transfer polynucleotides for the transfer of genes for expression into eukaryotic cells comprise an intron within a heterologous polynucleotide spliceable in a target cell. Advantageous gene transfer polynucleotides for the transfer of genes for expression into mammalian cells comprise an intron from immediate early genes 1, 2 or 3 of cytomegalovirus (CMV) from either human, primate or rodent cells (for example sequences at least 95% identical to any of SEQ ID NOs: 412-422), an intron from EF1a from any mammalian or avian species including human, rat, mice, chicken and Chinese hamster, (for example sequences at least 95% identical to any of SEQ ID NOs: 432-444), an intron from EEF2 from any mammalian or avian species including human, rat, mice, chicken and Chinese hamster, (for example sequences at least 95% identical to any of SEQ ID NOs: 464-471); an intron from actin from any mammalian or avian species including human, rat, mice, chicken and Chinese hamster (for example sequences at least 95% identical to any of SEQ ID NOs: 445-458), a GAPDH intron from any mammalian or avian species including human, rat, mice, chicken and Chinese hamster (for example sequences at least 95% identical to any of SEQ ID NOs: 459-461); an intron comprising the adenoviral major late protein enhancer for example sequences at least 95% identical to SEQ ID NOs: 462-463) or a hybrid/synthetic intron (for example sequences at least 95% identical to any of SEQ ID NOs: 423-431) within a heterologous polynucleotide.

Advantageous gene transfer polynucleotides for the transfer of genes for expression into eukaryotic cells comprise an enhancer and promoter, operably linked to a heterologous coding sequence. Such gene transfer polynucleotides may comprise combinations of enhancers and promoters in which an enhancer from one gene is combined with a promoter from a different gene, that is the enhancer is heterologous to the promoter. For example, for the transfer of genes for expression into mammalian cells, an immediate early CMV enhancer from rodent or human or primate (such as a sequence selected from SEQ ID NOs: 304-322) is advantageously followed by a promoter from an EF1a gene (such as a sequence selected from SEQ ID NOs: 325-346), or a promoter from a heterologous CMV gene (such as a sequence selected from SEQ ID NOs: 347-357), or a promoter from an EEF2 gene (such as a sequence selected from SEQ ID NOs: 358-368), or a promoter from an actin gene (such as a sequence selected from SEQ ID NOs: 369-378), or a promoter from a GAPDH gene (such as a sequence selected from SEQ ID NOs: 379-395) operably linked to a heterologous sequence.

Advantageous gene transfer polynucleotides for the transfer of genes for expression into eukaryotic cells comprise an operably linked promoter and an intron, operably linked to a heterologous open reading frame. Such gene transfer polynucleotides may comprise combinations of promoters and introns in which a promoter from one gene is combined with an intron from a different gene, that is the intron is heterologous to the promoter. For example, for the transfer of genes for expression into mammalian cells, an immediate early CMV promoter from rodent or human or primate (such as a sequence selected from SEQ ID NOs: 347-357) is advantageously followed by an intron from an EF1a gene (such as a sequence that is at least 95% identical to a sequence selected from SEQ ID NOs: 432-444) or an intron from an EEF2 gene (such as a sequence that is at least 95% identical to a sequence selected from SEQ ID NOs: 464-471), or an intron from an actin gene (such as a sequence that is at least 95% identical to a sequence selected from SEQ ID NOs: 445-458) operably linked to a heterologous sequence.

Advantageous gene transfer polynucleotides for the transfer of genes for expression into eukaryotic cells, comprise composite transcriptional initiation regulatory elements comprising promoters that are operably linked to enhancers and/or introns, and the composite transcriptional initiation regulatory element is operably linked to a heterologous sequence. Examples of advantageous composite transcriptional initiation regulatory elements that may be operably linked to a heterologous sequence in gene transfer polynucleotides for the transfer of genes for expression into mammalian cells are sequences selected from SEQ ID NOs: 473-565.

Expression of two open reading frames from a single polynucleotide can be accomplished by operably linking the expression of each open reading frame to a separate promoter, each of which may optionally be operably linked to enhancers and introns as described above. This is particularly useful when expressing two polypeptides that need to interact at specific molar ratios, such as chains of an antibody or chains of a bispecific antibody, or a receptor and its ligand. It is often advantageous to prevent transcriptional promoter interference by placing a genetic insulator between the two open reading frames, for example to the 3' of the polyadenylation sequence operably linked to the first open reading frame and to the 5' of the promoter operably linked to the second open reading frame encoding the second polypeptide. Transcriptional promoter interference may also be prevented by effectively terminating transcription of the first gene. In many eukaryotic cells the use of strong polyA signal sequences between two open reading frames will reduce transcriptional promote interference. Examples of polyA signal sequences that can be used to effectively terminate transcription are given as SEQ ID NOs: 566-595. Advantageous gene transfer polynucleotides comprise a sequence that is at least 95% identical to a sequence selected from SEQ ID NOs: 566-595 operably linked to a heterologous open reading frame. Advantageous composite regulatory elements for the termination of transcription of a first gene and the initiation of transcription of a second gene include sequences given as SEQ ID NOs: 596-779. Particularly advantageous gene transfer polynucleotides for the transfer of a first and a second open reading frame for co-expression into mammalian cells comprise a sequence at least 90% identical or at least 95% identical or at least 99% identical to or 100% identical to a sequence selected from SEQ ID NOS: 596-779, separating two heterologous open reading frames.

5.2.4 Selection of Target Cells Comprising Gene Transfer Polynucleotides

A target cell whose genome comprises a stably integrated transfer polynucleotide may be identified, if the gene transfer polynucleotide comprises an open reading frame encoding a selectable marker, by exposing the target cells to conditions that favor cells expressing the selectable marker ("selection conditions"). It is advantageous for a gene transfer polynucleotide to comprise an open reading frame encoding a selectable marker such as an enzyme that confers resistance to antibiotics such as neomycin (resistance conferred by an aminoglycoside 3-phosphotransferase e.g. a sequence selected from SEQ ID NOs: 114-117), puromycin (resistance conferred by puromycin acetyltransferase e.g. a sequence selected from SEQ ID NOs: 120-122), blasticidin (resistance conferred by a blasticidin acetyltransferase and a blasticidin deaminase e.g. SEQ ID NO: 124), hygromycin B (resistance conferred by hygromycin B phosphotransferase e.g. a sequence selected from SEQ ID NOs: 118-119) and zeocin (resistance conferred by a binding protein encoded by the ble gene, for example SEQ ID NO: 111). Other selectable markers include those that are fluorescent (such as open reading frames encoding GFP, RFP etc.) and can therefore be selected for example using flow cytometry. Other selectable markers include open reading frames encoding transmembrane proteins that are able to bind to a second molecule (protein or small molecule) that can be fluorescently labelled so that the presence of the transmembrane protein can be selected for example using flow cytometry.

A gene transfer polynucleotide may comprise a selectable marker open reading frame encoding glutamine synthetase (GS, for example a sequence selected from SEQ ID NOs: 126-130) which allows selection via glutamine metabolism. Glutamine synthase is the enzyme responsible for the biosynthesis of glutamine from glutamate and ammonia, it is a crucial component of the only pathway for glutamine formation in a mammalian cell. In the absence of glutamine in the growth medium, the GS enzyme is essential for the survival of mammalian cells in culture. Some cell lines, for example mouse myeloma cells do not express enough GS enzyme to survive without added glutamine. In these cells a transfected GS open reading frame can function as a selectable marker by permitting growth in a glutamine-free medium. Other cell lines, for example Chinese hamster ovary (CHO) cells, express enough GS enzyme to survive without exogenously added glutamine. These cell lines can be manipulated by genome editing techniques including CRISPR/Cas9 to reduce or eliminate the activity of the GS enzyme. In all of these cases, GS inhibitors such as methionine sulphoximine (MSX) can be used to inhibit a cell's endogenous GS activity. Selection protocols include introducing a gene transfer polynucleotide comprising sequences encoding a first polypeptide and a glutamine synthase selectable marker, and then treating the cell with inhibitors of glutamine synthase such as methionine sulphoximine. The higher the levels of methionine sulphoximine that are used, the higher the level of glutamine synthase expression is required to allow the cell to synthesize enough glutamine to survive. Some of these cells will also show an increased expression of the first polypeptide.

Preferably the GS open reading frame is operably linked to a weak promoter or other sequence elements that attenuate expression as described herein, such that high levels of expression can only occur if many copies of the gene transfer polynucleotide are present, or if they are integrated in a position in the genome where high levels of expression occur. In such cases it may be unnecessary to use the inhibitor methionine sulphoximine: simply synthesizing enough glutamine for cell survival may provide a sufficiently stringent selection if expression of the glutamine synthetase is attenuated.

A gene transfer polynucleotide may comprise a selectable marker open reading frame encoding dihydrofolate reductase (DHFR, for example a sequence selected from SEQ ID NO: 112-113) which is required for catalyzing the reduction of 5,6-dihydrofolate (DHF) to 5,6,7,8-tetrahydrofolate (THF). Some cell lines do not express enough DHFR to survive without added hypoxanthine and thymidine (HT). In these cells a transfected DHFR open reading frame can function as a selectable marker by permitting growth in a hypoxanthine and thymidine-free medium. DHFR-deficient cell lines, for example Chinese hamster ovary (CHO) cells can be produced by genome editing techniques including CRISPR/Cas9 to reduce or eliminate the activity of the endogenous DHRF enzyme. DHFR confers resistance to methotrexate (MTX). DHFR can be inhibited by higher levels of methotrexate. Selection protocols include introducing a construct comprising sequences encoding a first polypeptide and a DHFR selectable marker into a cell with or without a functional endogenous DHFR gene, and then treating the cell with inhibitors of DHFR such as methotrexate. The higher the levels of methotrexate that are used, the higher the level of DHFR expression is required to allow the cell to synthesize enough DHFR to survive. Some of these cells will also show an increased expression of the first polypeptide. Preferably the DHFR open reading frame is operably linked to a weak promoter or other sequence elements that attenuate expression as described above, such that high levels of expression can only occur if many copies of the gene transfer polynucleotide are present, or if they are integrated in a position in the genome where high levels of expression occur.

High levels of expression may be obtained from genes encoded on gene transfer polynucleotides that are integrated at regions of the genome that are highly transcriptionally active, or that are integrated into the genome in multiple copies, or that are present extrachromosomally in multiple copies. It is often advantageous to operably link the open reading frame encoding the selectable marker to expression control elements that result in low levels of expression of the selectable polypeptide from the gene transfer polynucleotide and/or to use conditions that provide more stringent selection. Under these conditions, for the expression cell to produce sufficient levels of the selectable polypeptide encoded on the gene transfer polynucleotide to survive the selection conditions, the gene transfer polynucleotide can either be present in a favorable location in the cell's genome for high levels of expression, or a sufficiently high number of copies of the gene transfer polynucleotide can be present, such that these factors compensate for the low levels of expression achievable because of the expression control elements.

Genomic integration of transposons in which a selectable marker is operably linked to regulatory elements that only weakly express the marker usually requires that the transposon be inserted into the target genome by a transposase, see for example Section 6.1.3. By operably linking the selectable marker to elements that result in weak expression, cells are selected which either incorporate multiple copies of the transposon, or in which the transposon is integrated at a favorable genomic location for high expression. Using a gene transfer system that comprises a transposon and a corresponding transposase increases the likelihood that cells will be produced with multiple copies of the transposon, or in which the transposon is integrated at a favorable genomic location for high expression. Gene transfer systems comprising a transposon and a corresponding transposase are thus particularly advantageous when the transposon comprises a selectable marker operably linked to a weak promoter.

A nucleic acid to be expressed as an RNA or protein and a selectable marker may be included on the same gene transfer polynucleotide, but operably linked to different promoters. In this case low expression levels of the selectable marker may be achieved by using a weakly active constitutive promoter such as the phosphoglycerokinase (PGK) promoter (such as a promoter selected from SEQ ID NOs: 396-402), the Herpes Simplex Virus thymidine kinase (HSV-TK) promoter (e.g. SEQ ID NO: 405), the MC promoter (for example SEQ ID NO: 406), the ubiquitin promoter (for example SEQ ID NO: 403). Other weakly active promoters may be deliberately constructed, for example a promoter attenuated by truncation, such as a truncated SV40 promoter (for example a sequence selected from SEQ ID NO: 407-408), a truncated HSV-TK promoter (for example SEQ ID NO: 404), or a promoter attenuated by insertion of a 5'UTR unfavorable for expression (for example a sequence selected from SEQ ID NOS: 410-411) between a promoter and the open reading frame encoding the selectable polypeptide. Particularly advantageous gene transfer polynucleotides comprise a promoter sequence selected from SEQ ID NOS: 396-409, operably linked to an open reading frame encoding a selectable marker.

Expression levels of a selectable marker may also be advantageously reduced by other mechanisms such as the insertion of the SV40 small t antigen intron after the open reading frame for the selectable marker. The SV40 small t intron accepts aberrant 5' splice sites, which can lead to deletions within the preceding open reading frame in a fraction of the spliced mRNAs, thereby reducing expression of the selectable marker. Particularly advantageous gene transfer polynucleotides comprise intron SEQ ID NO: 472, operably linked to an open reading frame encoding a selectable marker. For this mechanism of attenuation to be effective, it is preferable for the open reading frame encoding the selectable marker to comprise a strong intron donor within its coding region. DNA sequences SEQ ID NOs: 131-134 are exemplary nucleic acid sequences that encode glutamine synthetase sequences with SEQ ID NOs: 126-129 respectively. Each of these nucleic acid sequences comprises an intron donor, and which may be operably linked to the SV40 small t antigen intron by placing the intron into the 3' UTR of the glutamine synthetase open reading frame. Sequence SEQ ID NO: 123 is an exemplary nucleic acid sequence encoding puromycin acetyl transferase SEQ ID NO: 122, which comprises an intron donor, and which may be operably linked to the SV40 small t antigen intron by placing the intron into the 3' UTR of the puromycin open reading frame. Advantageous gene transfer polynucleotides comprise a sequence at least 90% identical or at least 95% identical or at least 99% identical to, or 100% identical to a sequence selected from one of SEQ ID NO: 123 or 131-134, operably linked to SEQ ID NO: 472.

Expression levels of a selectable marker may also be advantageously reduced by other mechanisms such as insertion of an inhibitory 5'-UTR within the transcript, for example SEQ ID NOs: 410-411. Particularly advantageous gene transfer polynucleotides comprise a promoter operably linked to an open reading frame encoding a selectable marker, wherein a sequence that is at least 90% identical or at least 95% identical or at least 99% identical to, or 100% identical to SEQ ID NO: 410-411 is interposed between the promoter and the selectable marker.

Exemplary nucleic acid sequences comprising the glutamine synthetase coding sequence operably linked to regulatory sequences expressible in mammalian cells include SEQ ID NOs: 152-221 and 283-285. A gene transfer polynucleotide comprising a sequence selected from SEQ ID NOs: 152-221 or 283-285, upon integration into the genome of a target cell, expresses glutamine synthetase, thereby helping a cell to grow in the absence of added glutamine or in the presence of MSX. Regulatory elements in these sequences have been balanced to produce low levels of expression of glutamine synthetase, providing a selective advantage for target cells whose genome comprises either multiple copies of the gene transfer polynucleotide, or for target calls whose genome comprises copies of the gene transfer polynucleotide in regions of the genome that are favorable for expression of encoded genes. Advantageous gene transfer polynucleotides comprise a sequence selected from SEQ ID NO: 152-221 or 283-285, and they may further comprise a left transposon end and a right transposon end.

Exemplary nucleic acid sequences comprising the blasticidin-S-transferase coding sequence operably linked to regulatory sequences expressible in mammalian cells include SEQ ID NOs: 222-228. A gene transfer polynucleotide comprising a sequence selected from SEQ ID NOs: 222-228, upon integration into the genome of a target cell, expresses blasticidin-S-transferase, thereby helping a cell to grow in the presence of added blasticidin. Regulatory elements in these sequences have been balanced to produce low levels of expression of blasticidin-S-transferase, providing a selective advantage for target cells whose genome comprises either multiple copies of the gene transfer polynucleotide, or for target calls whose genome comprises copies of the gene transfer polynucleotide in regions of the genome that are favorable for expression of encoded genes. Advantageous gene transfer polynucleotides comprise a sequence selected from SEQ ID NOs: 222-228, and they may further comprise a left transposon end and a right transposon end.

Exemplary nucleic acid sequences comprising the hygromycin B phosphotransferase coding sequence operably linked to regulatory sequences expressible in mammalian cells include SEQ ID NOs: 229-230. A gene transfer polynucleotide comprising a sequence selected from SEQ ID NOs: 229-230, upon integration into the genome of a target cell, expresses hygromycin B phosphotransferase, thereby helping a cell to grow in the presence of added hygromycin. Regulatory elements in these sequences have been balanced to produce low levels of expression of hygromycin B phosphotransferase, providing a selective advantage for target cells whose genome comprises either multiple copies of the gene transfer polynucleotide, or for target calls whose genome comprises copies of the gene transfer polynucleotide in regions of the genome that are favorable for expression of encoded genes. Advantageous gene transfer polynucleotides comprise a sequence selected from SEQ ID NOs: 229-230, and they may further comprise a left transposon end and a right transposon end.

Exemplary nucleic acid sequences comprising the aminoglycoside 3'-phosphotransferase coding sequence operably linked to regulatory sequences expressible in mammalian cells include SEQ ID NOs: 221-223 and 259-260. A gene transfer polynucleotide comprising a sequence selected from SEQ ID NOs: 221-223 and 259-260, upon integration into the genome of a target cell, expresses aminoglycoside 3'-phosphotransferase, thereby helping a cell to grow in the presence of added neomycin. Regulatory elements in these sequences have been balanced to produce low levels of expression of aminoglycoside 3'-phosphotransferase, providing a selective advantage for target cells whose genome comprises either multiple copies of the gene transfer polynucleotide, or for target calls whose genome comprises copies of the gene transfer polynucleotide in regions of the genome that are favorable for expression of encoded genes. Advantageous gene transfer polynucleotides comprise a sequence selected from SEQ ID NOs: 221-223 and 259-260, and they may further comprise a left transposon end and a right transposon end.

Exemplary nucleic acid sequences comprising the puromycin acetyltransferase coding sequence operably linked to regulatory sequences expressible in mammalian cells include SEQ ID NOs: 234-253 and 261-285. A gene transfer polynucleotide comprising a sequence selected from SEQ ID NOs: 234-253 or 261-285, upon integration into the genome of a target cell, expresses puromycin acetyltransferase, thereby helping a cell to grow in the presence of added puromycin. Regulatory elements in these sequences have been balanced to produce low levels of expression of puromycin acetyltransferase, providing a selective advantage for target cells whose genome comprises either multiple copies of the gene transfer polynucleotide, or for target calls whose genome comprises copies of the gene transfer polynucleotide in regions of the genome that are favorable for expression of encoded genes. Advantageous gene transfer polynucleotides comprise a sequence selected from SEQ ID NOs: 234-253 or 261-285, and they may further comprise a left transposon end and a right transposon end.

Exemplary nucleic acid sequences comprising the ble gene coding sequence operably linked to regulatory sequences expressible in mammalian cells include SEQ ID NOs: 254-258. A gene transfer polynucleotide comprising a sequence selected from SEQ ID NOs: 254-258, upon integration into the genome of a target cell, expresses the ble gene, thereby helping a cell to grow in the presence of added zeocin. Regulatory elements in these sequences have been balanced to produce low levels of expression of ble gene product, providing a selective advantage for target cells whose genome comprises either multiple copies of the gene transfer polynucleotide, or for target calls whose genome comprises copies of the gene transfer polynucleotide in regions of the genome that are favorable for expression of encoded genes. Advantageous gene transfer polynucleotides comprise a sequence selected from SEQ ID NOs: 254-258, and they may further comprise a left transposon end and a right transposon end.

Exemplary nucleic acid sequences comprising the dihydrofolate reductase coding sequence operably linked to regulatory sequences expressible in mammalian cells include SEQ ID NOs: 135-151 and 259-282. A gene transfer polynucleotide comprising a sequence selected from SEQ ID NOs: 135-151 or 259-282, upon integration into the genome of a target cell, expresses dihydrofolate reductase, thereby helping a cell to grow in the absence of added hypoxanthine and thymidine or in the presence of MTX. Regulatory elements in these sequences have been balanced to produce low levels of expression of dihydrofolate reductase, providing a selective advantage for target cells whose genome comprises either multiple copies of the gene transfer polynucleotide, or for target calls whose genome comprises copies of the gene transfer polynucleotide in regions of the genome that are favorable for expression of encoded genes. Advantageous gene transfer polynucleotides comprise a sequence selected from SEQ ID NOs: 135-151 or 259-282, and they may further comprise a left transposon end and a right transposon end.

The use of transposons and transposases in conjunction with weakly expressed selectable markers has several advantages over non-transposon constructs. One is that linkage between expression of the first polypeptide and the selectable marker is better for transposons, because a transposase integrates the entire sequence that lies between the two transposon ends into the genome. In contrast when heterologous DNA is introduced into the nucleus of a eukaryotic cell, for example a mammalian cell, it is gradually broken into random fragments which may either be integrated into the cell's genome or degraded. Thus if a gene transfer polynucleotide comprising sequences that encode a first polypeptide and a selectable marker is introduced into a population of cells, some cells will integrate the sequences encoding the selectable marker but not those encoding the first polypeptide, and vice versa. Selection of cells expressing high levels of selectable marker is thus only somewhat correlated with cells that also express high levels of the first polypeptide. In contrast, because the transposase integrates all of the sequences between the transposon ends, cells expressing high levels of selectable marker are highly likely to also express high levels of the first polypeptide.

A second advantage of transposons and transposases is that they are much more efficient at integrating DNA sequences into the genome. A much higher fraction of the cell population is therefore likely to integrate one or more copies of the gene transfer polynucleotide into their genomes, so there will be a correspondingly higher likelihood of good stable expression of both the selectable marker and the first polypeptide.

A third advantage of piggyBac-like transposons and transposases is that piggyBac-like transposases are biased toward inserting their corresponding transposons into transcriptionally active chromatin. Each cell is therefore likely to integrate the gene transfer polynucleotide into a region of the genome from which genes are well expressed, so there will be a correspondingly higher likelihood of good stable expression of both the selectable marker and the first polypeptide.

5.2.5 A Novel Piggybac-Like Transposase from *Oryzias* Latipes

Natural DNA transposons undergo a 'cut and paste' system of replication in which the transposon is excised from a first DNA molecule and inserted into a second DNA molecule. DNA transposons are characterized by inverted terminal repeats (ITRs) and are mobilized by an element-encoded transposase. The piggyBac transposon/transposase system is particularly useful because of the precision with which the transposon is integrated and excised (see for example "Fraser, M. J. (2001) The TTAA-Specific Family of Transposable Elements: Identification, Functional Characterization, and Utility for Transformation of Insects. Insect Transgenesis: Methods and Applications. A. M. Handler and A. A. James. Boca Raton, Fla., CRC Press: 249-268"; and "US 20070204356 A1: PiggyBac constructs in vertebrates" and references therein).

Many sequences with sequence similarity to the piggyBac transposase from *Trichoplusia ni* have been found in the genomes of phylogenetically distinct species from fungi to mammals, but very few have been shown to possess transposase activity (see for example Wu M, et al (2011) Genetica 139:149-54. "Cloning and characterization of piggyBac-like elements in lepidopteran insects", and references therein).

Two properties of transposases that are of particular interest for genomic modifications are their ability to integrate a polynucleotide into a target genome, and their ability to precisely excise a polynucleotide from a target genome. Both of these properties can be measured with a suitable system.

A system for measuring the first step of transposition, which is excision of a transposon from a first polynucleotide, comprises the following components: (i) A first polynucleotide encoding a first selectable marker operably linked to sequences that cause it to be expressed in a selection host and (ii) A transposon comprising transposon ends recognized by a transposase. The transposon is present in, and interrupts the coding sequence of, the first selectable marker, such that the first selectable marker is not active. The transposon is placed in the first selectable marker such that precise excision of the first transposon causes the first selectable marker to be reconstituted. If an active transposase that can excise the first transposon is introduced into a host cell which comprises the first polynucleotide, the host cell will express the active first selectable marker. The activity of the transposase in excising the transposon can be measured as the frequency with which the host cells become able to grow under conditions that require the first selectable marker to be active.

If the transposon comprises a second selectable marker, operably linked to sequences that make the second selectable marker expressible in the selection host, transposition of the second selectable marker into the genome of the host cell will yield a genome comprising active first and second selectable markers. The activity of the transposase in transposing the transposon into a second genomic location can be measured as the frequency with which the host cells become able to grow under conditions that require the first and second selectable markers to be active. In contrast, if the first selectable marker is present, but the second is not, then this indicates that the transposon was excised from the first polynucleotide but was not subsequently transposed into a second polynucleotide. The selectable markers may, for example, be open reading frames encoding an antibiotic resistance protein, or an auxotrophic marker, or any other selectable marker.

We used such a system to test putative transposase/transposon combinations for activity, as described in Section 6.1. We used computational methods to search publicly available sequenced genomes for open reading frames with homology to known active piggyBac-like transposases. We selected transposase sequences that appeared to possess the DDDE motif characteristic of active piggyBac-like transposases and searched the DNA sequences flanking these putative transposases for inverted repeat sequences adjacent to a 5'-TTAA-3' target sequence. Amongst those that we identified were putative transposons with intact transposases from: *Spodoptera litura* (Genbank accession number MTZO01002002.1, protein accession number XP_022823959) with an open reading frame encoding a putative transposase with SEQ ID NO: 21 flanked by a putative left end with SEQ ID NO: 68 and a putative right end with SEQ ID NO: 69; *Pieris rapae* (NCBI genomic reference sequence NW_019093607.1, Genbank protein accession number XP_022123753.1) with an open reading frame encoding a putative transposase with SEQ ID NO: 22 flanked by a putative left end with SEQ ID NO: 70 and a putative right end with SEQ ID NO: 71; *Myzus persicae* (NCBI genomic reference sequence NW_019100532.1, protein accession number XP_022166603) with an open reading frame encoding a putative transposase with SEQ ID NO: 23 flanked by a putative left end with SEQ ID NO: 72 and a putative right end with SEQ ID NO: 73; *Onthophagus taurus* (NCBI genomic reference sequence NW_019280463, protein accession number XP_022900752) with an open reading frame encoding a putative transposase with SEQ ID NO: 24 flanked by a putative left end with SEQ ID NO: 74 and a putative right end with SEQ ID NO: 75; *Temnothorax curvispinosus* (NCBI genomic reference sequence NW_020220783.1, protein accession number XP_024881886) with an open reading frame encoding a putative transposase with SEQ ID NO: 25 flanked by a putative left end with SEQ ID NO: 76 and a putative right end with SEQ ID NO: 77; *Agrius planipenn* (NCBI genomic reference sequence NW_020442437.1, protein accession number XP_025836109) with an open reading frame encoding a putative transposase with SEQ ID NO: 26 flanked by a putative left end with SEQ ID NO: 78 and a putative right end with SEQ ID NO: 79; *Parasteatoda tepidariorum* (NCBI genomic reference sequence NW_018371884.1, protein accession number XP_015905033) with an open reading frame encoding a putative transposase with SEQ ID NO: 27 flanked by a putative left end with SEQ ID NO: 80 and a putative right end with SEQ ID NO: 81; *Pectinophora gossypiella* (Genbank accession number GU270322.1, protein ID ADB45159.1, also described in Wang et al, 2010. Insect Mol. Biol. 19, 177-184. "piggyBac-like elements in the pink bollworm, *Pectinophora gossypiella*") with an open reading frame encoding a putative transposase with SEQ ID NO: 28 flanked by a putative left end with SEQ ID NO: 82 and a putative right end with SEQ ID NO: 83; *Ctenoplusia agnata* (NCBI accession number GU477713.1, protein accession number ADV17598.1, also described by Wu M, et al (2011) Genetica 139:149-54. "Cloning and characterization of piggyBac-like elements in lepidopteran insects") with an open reading frame encoding a putative transposase with SEQ ID NO: 29 flanked by a putative left end with SEQ ID NO: 84 and a putative right end with SEQ ID NO: 85; *Macrostomum lignano* (NCBI genomic reference sequence NIVC01003029.1, protein accession number PAA53757) with an open reading frame encoding a putative transposase with SEQ ID NO: 30 flanked by a putative left end with SEQ ID NO: 86 and a putative right end with SEQ ID NO: 87; *Orussus abietinus* (NCBI accession number XM_012421754, protein accession number XP_012277177) with an open reading frame encoding a putative transposase with SEQ ID NO: 31 flanked by a putative left end with SEQ ID NO: 88 and a putative right end with SEQ ID NO: 89; *Eufriesea mexicana* (NCBI genomic reference sequence NIVC01003029.1, protein accession number XP_017759329) with an open reading frame encoding a putative transposase with SEQ ID NO:32 flanked by a putative left end with SEQ ID NO: 90 and a putative right end with SEQ ID NO: 91; *Spodoptera litura* (NCBI genomic reference sequence NC_036206.1, protein accession number XP_022824855) with an open reading frame encoding a putative transposase with SEQ ID NO: 33 flanked by a putative left end with SEQ ID NO: 92 and a putative right end with SEQ ID NO: 93; *Vanessa tameamea* (NCBI genomic reference sequence NW_020663261.1, protein accession number XP_026490968) with an open reading frame encoding a putative transposase with SEQ ID NO: 34 flanked by a putative left end with SEQ ID NO: 94 and a putative right end with SEQ ID NO: 95; *Blattella germanica* (NCBI genomic reference sequence PYGN01002011.1, protein accession number PSN31819) with an open reading frame encoding a putative transposase with SEQ ID NO: 35 flanked by a putative left end with SEQ ID NO: 96 and a putative right end with SEQ ID NO: 97; *Onthophagus taurus* (NCBI genomic reference sequence NW_019281532.1, protein accession number XP_022910826) with an open reading frame encoding a putative transposase with SEQ ID NO: 36 flanked by a putative left end with SEQ ID NO: 98 and a putative right end with SEQ ID NO: 99; *Onthophagus taurus* (NCBI genomic reference sequence NW_019281689.1, protein accession number XP_022911139) with an open reading frame encoding a putative transposase with SEQ ID NO: 37 flanked by a putative left end with SEQ ID NO: 100 and a putative right end with SEQ ID NO: 101; *Onthophagus taurus* (NCBI genomic reference sequence NW_019286114.1, protein accession number XP_022913435) with an open reading frame encoding a putative transposase with SEQ ID NO: 38 flanked by a putative left end with SEQ ID NO: 102 and a putative right end with SEQ ID NO: 103; *Megachile rotundata* (NCBI genomic reference sequence NW_003797295, protein accession number XP_012145925) with an open reading frame encoding a putative transposase with SEQ ID NO: 39 flanked by a putative left end with SEQ ID NO: 104 and a putative right end with SEQ ID NO: 105; *Xiphophorus maculatus* (NCBI genomic reference sequence NC_036460.1, protein accession number XP_023207869) with an open reading frame encoding a putative transposase with SEQ ID NO: 40 flanked by a putative left end with SEQ ID NO: 106 and a putative right end with SEQ ID NO: 107; and *Oryzias latipes* (NCBI accession number NC_019868.2, protein accession number XP_023815209) with an open reading frame encoding a putative transposase with SEQ ID NO: 782 flanked by a putative left end with SEQ ID NO: 1 and a putative right end with SEQ ID NO: 2.

5.2.5.1 The *Oryzias* Transposase and its Corresponding Transposon

One active transposase and its corresponding transposon identified by transposition activity in yeast was an *Oryzias* transposase, as described in Section 6.1.2. An *Oryzias* transposase comprises a polypeptide sequence that is at least 80% identical to, or at least 90% identical to, or at least 93% identical to, or at least 95% identical to, or at least 96% identical to, or at least 97% identical to, or at least 98% identical to or at least 99% identical to, or 100% identical to the sequence given by SEQ ID NO: 782, and which is capable of transposing the transposon from transposase reporter construct SEQ ID NO: 41, as described in Section 6.1.2. Exemplary non-natural *Oryzias* transposases include sequences given as SEQ ID NOs: 805-908.

An *Oryzias* transposase may be provided as a part of a gene transfer system as a protein, or as a polynucleotide encoding the *Oryzias* transposase, wherein the polynucleotide is expressible in the target cell. When provided as a polynucleotide, the *Oryzias* transposase may be provided as DNA or mRNA. If provided as DNA, the open reading frame encoding the *Oryzias* transposase is preferably operably linked to heterologous regulatory elements including a promoter that is active in the target cell such that the transposase is expressible in the target cell, for example a promoter that is active in a eukaryotic cell or a vertebrate cell or a mammalian cell. If provided as mRNA, the mRNA may be prepared in vitro from a DNA molecule in which the open reading frame encoding the *Oryzias* transposase is preferably operably linked to a heterologous promoter active in the in vitro transcription system used to prepare the mRNA, for example a T7 promoter.

An *Oryzias* transposon comprises a heterologous polynucleotide flanked by a left transposon end comprising a left ITR with sequence given by SEQ ID NO: 7 and a right transposon end comprising a right ITR with sequence given by SEQ ID NO: 8, and wherein the distal end of each ITR is immediately adjacent to a target sequence. Here and elsewhere when inverted repeats are defined by a sequence including a nucleotide defined by an ambiguity code, the identity of that nucleotide can be selected independently in the two repeats. A preferred target sequence is 5'-TTAA-3', although other useable target sequences may be used; preferably the target sequence on one side of the transposon is a direct repeat of the target sequence on the other side of the transposon. The left transposon end may further comprise additional sequences proximal to the ITR, for example a sequence at least 90% identical to, or 100% identical to a sequence selected from SEQ ID NOs: 5, 11 or 12. The right transposon end may further comprise additional sequences proximal to the ITR, for example a sequence at least 90% identical to, or 100% identical to a sequence selected from SEQ ID NOs: 6, 13, 14 or 15. The structure of a representative *Oryzias* transposon is shown in FIG. 1. An *Oryzias* transposon can be transposed by a transposase with a polypeptide sequence given by SEQ ID NO: 782, for example as encoded by a polynucleotide with sequence given by SEQ ID NO: 780 operably linked to a Gall promoter.

Transposon ends, including ITRs and target sequences may be added to the ends of a heterologous polynucleotide sequence to create a synthetic *Oryzias* transposon which may be efficiently transposed into a target eukaryotic genome by an *Oryzias* transposase. For example, SEQ ID NOs: 1, 16 and 17 each comprise a left 5'-TTAA-3' target sequence followed by a left transposon ITR followed by additional end sequences that may be added to one side of a heterologous polynucleotide, with the target sequence distal relative to the heterologous polynucleotide, to generate a synthetic *Oryzias* transposon. SEQ ID NOs: 2, 18, 19 and 20 each comprise additional end sequences followed by a right transposon ITR sequence followed by a right 5'-TTAA-3' target sequence that may be added to the other side of a heterologous polynucleotide, with the target sequence distal relative to the heterologous polynucleotide, to generate a synthetic *Oryzias* transposon. The preceding transposon end sequences comprise 5'-TTAA-3' as the target sequence, but this target sequence may be removed from both ends of the synthetic *Oryzias* transposon and replaced by an alternative target sequence.

*Oryzias* transposases recognize synthetic *Oryzias* transposons. They excise the transposon from a first DNA molecule, by cutting the DNA at the target sequence at the left end of one transposon end and the target sequence at the right end of the second transposon end, re-join the cut ends of the first DNA molecule to leave a single copy of the target sequence. The excised transposon sequence, including any heterologous DNA that is between the transposon ends, is integrated by the transposase into a target sequence of a second DNA molecule, such as the genome of a target cell. A cell whose genome comprises a synthetic *Oryzias* transposon is an embodiment of the invention.

5.2.5.2 The *Oryzias* Transposase is Active in Mammalian Cells

The looper moth piggyBac transposase has been shown to be active in a very wide variety of eukaryotic cells. In Section 6.1.2 we show that the *Oryzias* transposase can transpose its corresponding transposon into the genome of the yeast *Saccharomyces cerevisiae*. In Section 6.1.3 we show that the *Oryzias* transposase can transpose its corresponding transposon into the genome of a mammalian CHO cell. These results provide evidence that, like the other known active piggyBac-like transposases, the *Oryzias* transposase is also active in transposing its corresponding transposon into the genomes of most eukaryotic cells. Although the *Oryzias* transposase is active in a wide range of eukaryotic cells, the naturally occurring open reading frame encoding the *Oryzias* transposase (given by SEQ ID NO: 781) is unlikely to express well in a similarly wide range of cells, as optimal codon usage differs significantly between cell types. It is therefore advantageous to use a sequence other than a naturally occurring sequence to encode the transposase, in other words, to use codon-preferences of the cell type in which expression is to be performed. Likewise, the promoter and other regulatory sequences are selected so as to be active in the cell type in which expression is to be performed. An advantageous polynucleotide for expression of an *Oryzias* transposase comprises at least 2, 5, 10, 20, 30, 40 or 50 synonymous codon differences relative to SEQ ID NO: 781 at corresponding positions between the polynucleotide and SEQ ID NO:781, optionally wherein codons in the polynucleotide at the corresponding positions are selected for mammalian cell expression. An exemplary polynucleotide sequence for an *Oryzias* transposase with polypeptide sequence given by SEQ ID NOs: 782, where synonymous codon differences relative to SEQ ID NO: 781 at corresponding positions between the polynucleotide and SEQ ID NO:781 are selected for mammalian cell expression is given as SEQ ID NO: 780. The polynucleotide may be DNA or mRNA.

5.2.6 Hyperactive *Oryzias* Transposases

Individual favorable mutations may be combined in a variety of different ways, for example by "DNA shuffling" or by methods described in U.S. Pat. No. 8,635,029 B2 and Liao et al (2007, BMC Biotechnology 2007, 7:16 doi: 10.1186/1472-6750-7-16 "Engineering proteinase K using machine learning and synthetic genes"). A transposase with modified activity, either for activity on a new target sequence, or increased activity on an existing target sequence may be obtained by using variations of the selection scheme described herein (for example Section 6.1.6) with an appropriate corresponding transposon.

An alignment of known active piggyBac-like transposases may be used to identify amino acid changes likely to result in enhanced activity. Transposases are often deleterious to their hosts, so tend to accumulate mutations that inactivate them. However the mutations that accumulate in different transposases are different, as each occurs by random chance. A consensus sequence can be obtained from an alignment of sequences, and this can be used to improve activity (Ivics et al, 1997. Cell 91: 501-510. "Molecular reconstruction of Sleeping Beauty, a Tcl-like transposon from fish, and its transposition in human cells."). We aligned known active piggyBac-like transposases using the CLUSTAL algorithm, and enumerated the amino acids found at each position. This diversity is shown in Table 1 relative to an *Oryzias* transposase (relative to SEQ ID NO: 782), the amino acids shown in column C are found in known active piggyBac-like transposases at the equivalent position in an alignment, and are thus likely to be acceptable changes in an *Oryzias* transposase. Column D shows amino acid changes found in known active piggyBac-like transposases other than the *Oryzias* transposase at positions where there is good conservation within the rest of the transposase set, but the amino acid in the *Oryzias* transposase sequence is an outlier. Mutation of the position shown in column A to an amino acid shown in column D is particularly likely to result in enhanced transposase activity, because it changes the sequence of the *Oryzias* transposase toward the consensus.

We selected 60 amino acid substitutions to make in *Oryzias* transposase SEQ ID NO: 782 from column D in Table 1. The substitutions were E22D, D82K, A124C, Q131D, L138V, F149R, L156T, D160E, Y164F, I167L, A171T, G172A, R175K, K177N, G178R, L200R, T202R, I206L, I210L, N214D, W237F, V251L, V253I, V258L, M270I, I281F, A284L, M319L, G322P, L323V, H326R, F333W, Y337I, L361I, V386I, M400L, T402S, H404D, S408E, L409I, D422F, K435Q, Y440M, F455Y, V458L, D459N, S461A, A465S, V467I, L468I, W469Y, A512R, A514R, V515I, S524P, R548K, D549K, D550R, S551R and N562K. Genes encoding *Oryzias* transposase variants comprising combinations of these substitutions were synthesized and tested for transposase activity as described in Section 6.1.6.

We engineered more than 70 non-natural *Oryzias* transposase variants with excision or transposition activity in addition to the naturally occurring sequence SEQ ID NO: 782. Exemplary sequences of active non-natural *Oryzias* transposase variants are provided as SEQ ID NOs: 816-877. *Oryzias* transposase variants with enhanced excision activity relative to transposition activity are provided as SEQ ID NOs: 805-815.

*Oryzias* transposases can thus be created that are not naturally occurring sequences, but that are at least 99% identical, or at least 98% identical, or at least 97% identical, or at least 96% identical, or at least 95% identical, or at least 90% identical to, or at least 80% identical to SEQ ID NO: 782. Such variants can retain partial activity of the transposase of SEQ ID NO: 782 (as determined by either or both of transposition and/or excision activity), can be functionally equivalent of the transposase of SEQ ID NO: 782 in either or both of transposition and excision, or can have enhanced activity relative to the transposase of SEQ ID NO: 782 in transposition, excision activity or both. Such variants can include mutations shown herein to increase transposition and/or excision, mutations shown herein to be neutral as to transposition and/or excision, and mutations detrimental to transposition and/or integration. Preferred variants include mutations shown to be neutral or to enhance transposition/ and or excision. Some such variants lack mutations shown to be detrimental to transposition and/or excision. Some such variants include only mutations shown to enhance transposition, only mutations shown to enhance excision, or mutations shown to enhance both transposition and excision.

Enhanced activity means activity (e.g., transposition or excision activity) that is greater beyond experimental error than that of a reference transposase from which a variant was derived. The activity can be greater by a factor of e.g., 1.2, 1.5, 2, 5, 10, 15, 20, 50 or 100 fold of the reference transposase. The enhanced activity can lie within a range of for example 1.2-100 fold, 2-50 fold, 1.5-50 fold or 2-10 fold of the reference transposase. Here and elsewhere activities can be measured as demonstrated in the examples.

Functional equivalence means a variant transposase can mediate transposition and/or excision of the same transposon with a comparable efficiency (within experimental error) to a reference transposase.

Furthermore, variant sequences of SEQ ID NO: 782 can be created by combining two, three, four, or five or more substitutions selected from Table 1 column D. Combining beneficial substitutions, for example those shown in column D of Table 1 can result in hyperactive variants of SEQ ID NO: 782. Preferred hyperactive *Oryzias* transposases may comprise an amino acid substitution at a position selected from amino acid 22, 124, 131, 138, 149, 156, 160, 164, 167, 171, 175, 177, 202, 206, 210, 214, 253, 258, 281, 284, 361, 386, 400, 408, 409, 455, 458, 467, 468, 514, 515, 524, 548, 549, 550 and 551 relative to SEQ ID NO: 782 (see Section 6.1.6). Preferably the substitution is one shown in Table 1 columns C or D. An advantageous hyperactive *Oryzias* transposase comprises an amino acid substitution selected from E22D, A124C, Q131D, L138V, F149R, L156T, D160E, Y164F, I167L, A171T, R175K, K177N, T202R, I206L, I210L, N214D, V253I, V258L, I281F, A284L, L361I, V386I, M400L, S408E, L409I, F455Y, V458L, V467I, L468I, A514R, V515I, S524P, R548K, D549K, D550R and S551R (relative to SEQ ID NO: 782). Some hyperactive *Oryzias* transposases may further comprise a heterologous nuclear localization sequence.

Some engineered *Oryzias* transposases may have a greater excision activity, relative to the transposition activity of the transposase. An advantageous *Oryzias* transposase hyperactive for excision may comprise an amino acid substitution at a position selected from amino acid 156, 164, 167, 171, 175, 177, 284 and 455 relative to the sequence of SEQ ID NO: 782, for example an amino acid substitution selected from L156T, Y164F, I167L, A171T, R175K, K177N, A284L and F455Y. Such substitutions may be combined to engineer an *Oryzias* transposase that has stronger excision than transposition activities. Exemplary *Oryzias* transposases that are hyperactive for excision include a sequence selected from SEQ ID NOs: 805-815.

Preferred hyperactive *Oryzias* transposases comprise an amino acid sequence, other than a naturally occurring protein (e.g., not a transposase whose amino acid sequence comprises SEQ ID NO: 782), that is at least 80%, 85%, 90%, 95%, 96%, 97%, 98%, 99%, or 100% identical to the amino acid sequence of any of SEQ ID NOs: 805-877 and comprise a substitution at a position selected from amino acid 22, 124, 131, 138, 149, 156, 160, 164, 167, 171, 175, 177, 202, 206, 210, 214, 253, 258, 281, 284, 361, 386, 400, 408, 409, 455, 458, 467, 468, 514, 515, 524, 548, 549, 550 and 551 relative to SEQ ID NO: 782. Preferably the hyperactive *Oryzias* transposase comprises an amino acid substitution, relative to the sequence of SEQ ID NO: 782, selected from E22D, A124C, Q131D, L138V, F149R, L156T, D160E, Y164F, I167L, A171T, R175K, K177N, T202R, I206L, I210L, N214D, V253I, V258L, I281F, A284L, L361I, V386I, M400L, S408E, L409I, F455Y, V458L, V467I, L468I, A514R, V515I, S524P, R548K, D549K, D550R and S551R or any combination of substitutions thereof including at least 1, 2, 3, 4, 5, 6, 7, 8, 9, 10 or all of these mutations.

Methods of creating transgenic cells using naturally occurring or hyperactive *Oryzias* transposases are an aspect of the invention. A method of creating a transgenic cell comprises (i) introducing into a eukaryotic cell a naturally occurring or hyperactive *Oryzias* transposase (as a protein or as a polynucleotide encoding the transposase) and a corresponding *Oryzias* transposon. Creating the transgenic cell may further comprise (ii) identifying a cell in which an *Oryzias* transposon is incorporated into the genome of the eukaryotic cell. Identifying the cell in which an *Oryzias* transposon is incorporated into the genome of the eukaryotic cell may comprise selecting the eukaryotic cell for a selectable marker encoded on the *Oryzias* transposon. The selectable marker may be any selectable polypeptide, including any described herein.

Activity of transposases may also be increased by fusion of nuclear localization signal (NLS) at the N-terminus, C-terminus, both at the N- and C-termini or internal regions of the transposase protein, as long as transposase activity is retained. A nuclear localization signal or sequence (NLS) is an amino acid sequence that 'tags' or facilitates interaction of a protein, either directly or indirectly with nuclear transport proteins for import into the cell nucleus. Nuclear localization signals (NLS) used can include consensus NLS sequences, viral NLS sequences, cellular NLS sequences, and combinations thereof.

Transposases may also be fused to other protein functional domains. Such protein functional domains can include DNA binding domains, flexible hinge regions that can facilitate one or more domain fusions, and combinations thereof. Fusions can be made either to the N-terminus, C-terminus, or internal regions of the transposase protein so long as transposase activity is retained. Fusions to DNA binding domains can be used to direct the *Oryzias* transposase to a specific genomic locus or loci. DNA binding domains may include a helix-turn-helix domain, a zinc-finger domain, a leucine zipper domain, a TALE (transcription activator-like effector) domain, a CRISPR-Cas protein or a helix-loop-helix domain. Specific DNA binding domains used can include a Gal4 DNA binding domain, a LexA DNA binding domain, or a Zif268 DNA binding domain. Flexible hinge regions used can include glycine/serine linkers and variants thereof.

5.3 Kits

The present invention also features kits comprising an *Oryzias* transposase as a protein or encoded by a nucleic acid, and/or an *Oryzias* transposon; or a gene transfer system as described herein comprising an *Oryzias* transposase as a protein or encoded by a nucleic acid as described herein, in combination with an *Oryzias* transposon; optionally together with a pharmaceutically acceptable carrier, adjuvant or vehicle, and optionally with instructions for use. Any of the components of the inventive kit may be administered and/or transfected into cells in a subsequent order or in parallel, e.g. an *Oryzias* transposase protein or its encoding nucleic acid may be administered and/or transfected into a cell as defined above prior to, simultaneously with or subsequent to administration and/or transfection of an *Oryzias* transposon. Alternatively, an *Oryzias* transposon may be transfected into a cell as defined above prior to, simultaneously with or subsequent to transfection of an *Oryzias* transposase protein or its encoding nucleic acid. If transfected in parallel, preferably both components are provided in a separated formulation and/or mixed with each other directly prior to administration to avoid transposition prior to transfection. Additionally, administration and/or transfection of at least one component of the kit may occur in a time staggered mode, e.g. by administering multiple doses of this component.

6. EXAMPLES

The following examples illustrate the methods, compositions and kits disclosed herein and should not be construed as limiting in any way. Various equivalents will be apparent from the following examples; such equivalents are also contemplated to be part of the invention disclosed herein.

6.1 A New Transposase

6.1.1 Measuring Transposase Activity

As described in Section 5.2.5, transposition frequencies for active transposases may be measured using a system in which a transposon interrupts a selectable marker. Transposase reporter polynucleotides were constructed in which the open reading frame of the yeast *Saccharomyces cerevisiae* URA3 open reading frame was interrupted by a yeast TRP 1 open reading frame operably linked to a promoter and terminator such that it was expressible in the yeast *Saccharomyces cerevisiae*. The TRP1 gene was flanked by putative transposon ends with 5'-TTAA-3' target sites, such that excision of the putative transposon would leave a single copy of the 5'-TTAA-3' target site and exactly reconstitute the URA3 open reading frame. A yeast transposase reporter strain was constructed by integrating the transposase reporter polynucleotide into the URA3 gene of a haploid yeast strain auxotrophic for LEU2 and TRP1, such that the strain became LEU2−, URA3− and TRP1+.

Transposases were tested for their ability to transposase the TRP1 gene-containing transposons from within the URA3 open reading frame. Each open reading frame encoding a putative transposase was cloned into a *Saccharomyces cerevisiae* expression vector comprising a 2 micron origin of replication and a LEU2 gene expressible in *Saccharomyces*. Each transposase open reading frame was operably linked to a Gal1 promoter. Each cloned transposase open reading frame was transformed into a yeast transposase reporter strain and plated on minimal media lacking leucine. After 2 days, all LEU+ colonies were harvested by scraping the plates. The Gal promoter was induced by growing in galactose for 4 hours, and cells were then plated onto 3 different plates: plates lacking only leucine, plates lacking leucine and uracil, and plates lacking leucine, uracil and tryptophan. These plates were incubated for 2-4 days, and the colonies on each plate were counted, measuring the number of live cells, the number of transposon excision events and the number of transposon excision and re-integration (i.e. transposition events) respectively.

6.1.2 Identification of an Active *Oryzias* Piggybac-Like Transposase

As described in Section 5.2.5, twenty-one putative piggyBac-like transposases were identified from Genbank as being at least 20% identical to the piggyBac transposase from *Trichoplusia ni*. These putative transposases appeared to comprise the DDDE motif characteristic of active piggyBac-like transposases. The flanking DNA sequences were analyzed for the presence of inverted repeat sequences immediately adjacent to the 5'-TTAA-3' target sequence characteristic of piggyBac transposition. Putative left and right transposon end sequences comprising the sequence between the 5'-TTAA-3' target sequence and the open reading frame encoding the putative transposase were taken from these flanking sequences. These transposon ends were incorporated into transposase reporter constructs configured as described in Section 6.1.1 and integrated into the genome of *Saccharomyces cerevisiae* thereby generating transposase reporter strains. The corresponding transposase sequence for each reporter strain was back-translated, synthesized, cloned into a *Saccharomyces cerevisiae* expression vector and transformed into the reporter strain. Transposase activities were measured as described in Section 6.1.1.

The following twenty combinations showed no excision or transposition: reporter construct SEQ ID NO: 48 (comprising putative left transposon end SEQ ID NO: 68, and putative right transposon end SEQ ID NO: 69) with transposase SEQ ID NO: 21, reporter construct SEQ ID NO: 49 (comprising putative left transposon end SEQ ID NO: 70, and putative right transposon end SEQ ID NO: 71) with transposase SEQ ID NO: 22, reporter construct SEQ ID NO: 50 (comprising putative left transposon end SEQ ID NO: 72, and putative right transposon end SEQ ID NO: 73) with transposase SEQ ID NO: 23, reporter construct SEQ ID NO: 51 (comprising putative left transposon end SEQ ID NO: 74, and putative right transposon end SEQ ID NO: 75) with transposase SEQ ID NO: 24, reporter construct SEQ ID NO: 52 (comprising putative left transposon end SEQ ID NO: 76, and putative right transposon end SEQ ID NO: 77) with transposase SEQ ID NO: 25, reporter construct SEQ ID NO: 53 (comprising putative left transposon end SEQ ID NO: 78, and putative right transposon end SEQ ID NO: 79) with transposase SEQ ID NO: 26, reporter construct SEQ ID NO: 54 (comprising putative left transposon end SEQ ID NO: 80, and putative right transposon end SEQ ID NO: 81) with transposase SEQ ID NO: 27, reporter construct SEQ ID NO: 55 (comprising putative left transposon end SEQ ID NO: 82, and putative right transposon end SEQ ID NO: 83) with transposase SEQ ID NO: 28, reporter construct SEQ ID NO: 56 (comprising putative left transposon end SEQ ID NO: 84, and putative right transposon end SEQ ID NO: 85) with transposase SEQ ID NO: 29, reporter construct SEQ ID NO: 57 (comprising putative left transposon end SEQ ID NO: 86, and putative right transposon end SEQ ID NO: 87) with transposase SEQ ID NO: 30, reporter construct SEQ ID NO: 58 (comprising putative left transposon end SEQ ID NO: 88, and putative right transposon end SEQ ID NO: 89) with transposase SEQ ID NO: 31, reporter construct SEQ ID NO: 59 (comprising putative left transposon end SEQ ID NO: 90, and putative right transposon end SEQ ID NO: 91) with transposase SEQ ID NO: 32, reporter construct SEQ ID NO: 60 (comprising putative left transposon end SEQ ID NO: 92, and putative right transposon end SEQ ID NO: 93) with transposase SEQ ID NO: 33, reporter construct SEQ ID NO: 61 (comprising putative left transposon end SEQ ID NO: 94, and putative right transposon end SEQ ID NO: 95) with transposase SEQ ID NO: 34, reporter construct SEQ ID NO: 62 (comprising putative left transposon end SEQ ID NO: 96, and putative right transposon end SEQ ID NO: 97) with transposase SEQ ID NO: 35, reporter construct SEQ ID NO: 63 (comprising putative left transposon end SEQ ID NO: 98, and putative right transposon end SEQ ID NO: 99) with transposase SEQ ID NO: 36, reporter construct SEQ ID NO: 64 (comprising putative left transposon end SEQ ID NO: 100, and putative right transposon end SEQ ID NO: 101) with transposase SEQ ID NO: 37, reporter construct SEQ ID NO: 65 (comprising putative left transposon end SEQ ID NO: 102, and putative right transposon end SEQ ID NO: 103) with transposase SEQ ID NO: 38, reporter construct SEQ ID NO: 66 (comprising putative left transposon end SEQ ID NO: 104, and putative right transposon end SEQ ID NO: 105) with transposase SEQ ID NO: 39, reporter construct SEQ ID NO: 67 (comprising putative left transposon end SEQ ID NO: 106, and putative right transposon end SEQ ID NO: 107) with transposase SEQ ID NO: 40. This is consistent with reports in the literature that while computational recognition of sequences that are homologous to the piggyBac transposase from *Trichoplusia ni* is straightforward, most of these sequences are transpositionally inactive, even when they appear to have intact terminal repeats and the transposases appear to comprise the DDDE motif found in active piggyBac-like transposases. It is therefore necessary to measure excision and transposition activity, in order to identify novel active piggyBac-like transposases and transposons.

One transposase that showed good activity in excising its corresponding transposon from the reporter construct (shown by the appearance of URA+ colonies) and transposing the TRP gene in the transposon into another genomic location in the *Saccharomyces cerevisiae* reporter strain was transposase SEQ ID NO: 782. Transposase SEQ ID NO: 782 was able to transpose the transposon from reporter construct SEQ ID NO: 41. This is shown in Table 2: the number of excision events, measured by the appearance of URA+ colonies, is shown in column G; the number of full transposition events, measured by the appearance of URA+ TRP+ colonies, is shown in column H.

6.1.3 The *Oryzias* Transposase is Active in Mammalian Cells

PiggyBac-like transposases can transpose their corresponding transposons into the genomes of eukaryotic cells including yeast cells such as *Pichia pastoris* and *Saccharomyces cerevisiae*, and mammalian cells such as human embryonic kidney (HEK) and Chinese hamster ovary (CHO) cells. To determine the activity of piggyBac-like transposases in mammalian cells, we constructed gene transfer polynucleotides comprising transposon ends, and further comprising a selectable marker encoding glutamine synthetase with a polypeptide sequence given by SEQ ID NO: 129, operably linked to regulatory elements that give weak glutamine synthetase expression, the sequence of the glutamine synthetase and its associated regulatory elements given by SEQ ID NO: 172. The gene transfer polynucleotides further comprised open reading frames encoding the heavy and light chains of an antibody, each operably linked to a promoter and polyadenylation signal sequence. The gene transfer polynucleotide (with SEQ ID NO: 108) comprised a left transposon end comprising a 5'-TTAA-3' target integration sequence immediately followed by an *Oryzias* left transposon end with ITR sequence given by SEQ ID NO: 9, which is an embodiment of SEQ ID NO: 7. The gene transfer polynucleotide further comprised an *Oryzias* right transposon end with ITR sequence given by SEQ ID NO: 10 (which is an embodiment of SEQ ID NO: 8) immediately followed by a 5'-TTAA-3' target integration sequence. The two *Oryzias* transposon ends were placed on either side of the heterologous polynucleotide comprising the glutamine synthetase selectable marker and the open reading frames encoding the heavy and light chains of the antibody. The left transposon end further comprised a sequence given by SEQ ID NO: 5 immediately adjacent to the left ITR and proximal to the heterologous polynucleotide. The right transposon end further comprised a sequence given by SEQ ID NO: 6 immediately adjacent to the right ITR and proximal to the heterologous polynucleotide.

Gene transfer polynucleotides were transfected into CHO cells which lacked a functional glutamine synthetase gene. Cells were transfected by electroporation with 25 µg of gene transfer polynucleotide DNA, either with or without a co-transfection with 3 µg of DNA comprising a gene encoding a transposase operably linked to a human CMV promoter and a polyadenylation signal sequence. The cells were incubated in media containing 4 mM glutamine for 48 hours following electroporation, and subsequently diluted to 300,000 cells per ml in media lacking glutamine. Cells were exchanged into fresh glutamine-free media every 5 days. The viability of the cells from each transfection were measured at various times following transfection using a Beckman-Coulter Vi-Cell. The total number of viable cells were also measured with the same instrument. The results are shown in Table 3.

As shown in Table 3, the viability of cells transfected with the gene transfer polynucleotide but no transposase fell to about 27% by 12 days post-transfection (column B). The total number of live cells fell to fewer than 50,000 per ml within 7 days (column C). At or below this density of live cells, viability measurements become inaccurate. The culture never recovered. In contrast when gene transfer polynucleotide with SEQ ID NO: 108 was co-transfected with *Oryzias* transposase SEQ ID NO: 782, cells recovered to greater than 90% viability within 10 days (Table 3 column D), by which time the density of live cells exceeded 2 million per ml (Table 3 column E). This shows that a gene transfer polynucleotide comprising a left and right *Oryzias* transposon end can be efficiently transposed into the genome of a mammalian target cell by a corresponding *Oryzias* transposase.

The recovered pools of CHO cells comprising piggyBac-like transposons integrated into their genomes were grown in a 14 day fed-batch using Sigma Advanced Fed Batch media. Antibody titers were measured in culture supernatant using an Octet. Table 4 shows the titers measured at 7, 10, 12 and 14 days of the fed batch culture. The titer of antibody from cells comprising gene transfer polynucleotide with SEQ ID NO: 108, that had been integrated by co-transfection with the *Oryzias* transposase SEQ ID NO: 782 reached approximately 2 g/L after 14 days. This shows that the *Oryzias* transposon and its corresponding transposase, as described in Section 5.2.5, is a novel, piggyBac-like transposon/transposase system that is active in mammalian cells and useful for developing protein expressing cell lines and engineering the genomes of mammalian cells.

6.1.4 Messenger RNA Encoding the *Oryzias* Transposase is Active in Mammalian Cells We further tested gene transfer polynucleotide with SEQ ID NO: 108, whose configuration is described in Section 6.1.3, to determine whether the synthetic *Oryzias* transposon could be integrated into the genome of a mammalian cell if the corresponding transposase was provided in the form of mRNA.

mRNA encoding transposases was prepared by in vitro transcription using T7 RNA polymerase. The mRNA comprised a 5' sequence SEQ ID NO: 109 preceding the sequence encoding the open reading frame, and a 3' sequence SEQ ID NO: 110 following the stop codon at the end of the open reading frame. The mRNA had an anti-reverse cap analog (3'-O-Me-m$^7$G(5')ppp(5')G. DNA molecules comprising a sequence encoding a transposase operably linked to a heterologous promoter that is active in vitro are useful for the preparation of transposase mRNA. Isolated mRNA molecules comprising a sequence encoding a transposase are useful for integration of a corresponding transposon into a target genome.

Gene transfer polynucleotide 354498 with SEQ ID NO: 108 comprised a selectable marker encoding glutamine synthetase with a polypeptide sequence given by SEQ ID NO: 129, encoded by DNA sequence given by SEQ ID NO: 134 and operably linked to regulatory elements that give weak glutamine synthetase expression, the sequence of the glutamine synthetase and its associated regulatory elements given by SEQ ID NO: 172. Gene transfer polynucleotide SEQ ID NO: 108 further comprised open reading frames encoding the heavy and light chains of an antibody, each operably linked to a promoter and polyadenylation signal sequence. Gene transfer polynucleotide SEQ ID NO: 108 further comprised an *Oryzias* left transposon end with sequence given by SEQ ID NO: 1 and an *Oryzias* right transposon end with sequence given by SEQ ID NO: 2.

mRNA encoding *Oryzias* transposase was prepared by in vitro transcription using T7 RNA polymerase. The mRNA comprised a 5' sequence SEQ ID NO: 109 preceding the open reading frame, an open reading frame encoding an *Oryzias* transposase (amino acid sequence SEQ ID NO: 782, nucleotide sequence SEQ ID NO: 780), and a 3' sequence SEQ ID NO: 110 following the stop codon at the end of the open reading frame. Gene transfer polynucleotide SEQ ID NO: 108 was transfected into CHO cells which lacked a functional glutamine synthetase gene. Cells were transfected by electroporation: 25 µg of gene transfer polynucleotide DNA was co-transfected with 3 µg of mRNA comprising an open reading frame encoding a corresponding transposase (amino acid sequence SEQ ID NO: 782, nucleotide sequence SEQ ID NO: 780. The cells were incubated in media containing 4 mM glutamine for 48 hours following electroporation, and subsequently diluted to 300,000 cells per ml in media lacking glutamine. Cells were exchanged into fresh glutamine-free media every 5 days. The viability of the cells from each transfection were measured at various times following transfection using a Beckman-Coulter Vi-Cell. The total number of viable cells were also measured with the same instrument. The results are shown in Table 5.

When gene transfer polynucleotide with SEQ ID NO: 108 was co-transfected with mRNA encoding *Oryzias* transposase SEQ ID NO: 782, viability fell to around 28% by 9 days post-transfection (Table 5 column B), by which time the density of live cells was around 40,000 per ml (Table 5 column C). Cell viability and the density of live cells then increased until by 28 days post-transfection viability was above 96% and there were over 3 million live cells per ml. This shows that a gene transfer polynucleotide comprising a left and right *Oryzias* transposon end can be efficiently transposed into the genome of a mammalian target cell when co-transfected with mRNA encoding a corresponding *Oryzias* transposase.

6.1.5 *Oryzias* Transposon End Sequences Active in Mammalian Cells

When we originally tested the *Oryzias* transposon, we used the entire sequence between the 5'-TTAA-3' target sequences and the transposase open reading frame as transposon ends. We have found that for other piggyBac-like sequences this full sequence is generally not required for transposition activity. We therefore constructed synthetic *Oryzias* transposons with truncated ends to determine whether these were transposable by an *Oryzias* transposase. A heterologous polynucleotide with SEQ ID NO: 42 encoded glutamine synthetase with a polypeptide sequence given by SEQ ID NO: 130, operably linked to regulatory elements that give weak glutamine synthetase expression as a selectable marker. On one side of the heterologous polynucleotide was a left *Oryzias* transposon end comprising a 5'-TTAA-3' integration target sequence immediately followed by a transposon ITR sequence with SEQ ID NO: 9, which is an embodiment of SEQ ID NO: 7. On the other side of the heterologous polynucleotide was a right *Oryzias* transposon end comprising a transposon ITR sequence with SEQ ID NO: 10 (which is an embodiment of SEQ ID NO: 8) immediately followed by a 5'-TTAA-3' integration target sequence. The transposon further comprised an additional sequence selected from SEQ ID NOs: 5, 11 and 12 immediately adjacent to (following) the left transposon ITR sequence. The transposon further comprised an additional sequence selected from SEQ ID NOs: 6, 13, 14 and 15 immediately adjacent to (preceding) the right transposon ITR sequence. Transposons were transfected into CHO cells which lacked a functional glutamine synthetase gene. Cells were transfected by electroporation: 25 μg of gene transfer polynucleotide DNA were transfected, optionally the cells were co-transfected with 3 μg of mRNA comprising an open reading frame encoding a corresponding transposase (amino acid sequence SEQ ID NO: 782, nucleotide sequence SEQ ID NO: 780). The cells were incubated in media containing 4 mM glutamine for 48 hours following electroporation, and subsequently diluted to 300,000 cells per ml in media lacking glutamine. Cells were exchanged into fresh glutamine-free media every 5 days. The viability of the cells from each transfection were measured at various times following transfection using a Beckman-Coulter Vi-Cell. The total number of viable cells were also measured with the same instrument. The results are shown in Table 6.

Table 6 columns B and C show the reduction in cell viability and viable cell density when cells were transfected with a transposon comprising a truncated left transposon end with SEQ ID NO: 11 and full-length right transposon end with SEQ ID NO: 6 in the absence of transposase. Cell viability and viable cell density can both be seen to fall throughout the experiment. In contrast when any the same transposon was co-transfected with mRNA encoding an *Oryzias* transposase, the cell viability and viable cell density fell initially, but had begun to recover by day 14 and was fully recovered between day 19 and 24 (Table 6 columns C and D). A comparable result was obtained when cells were transfected with a transposon comprising a truncated left transposon end with SEQ ID NO: 12 and full-length right transposon end with SEQ ID NO: 6 (compare Table 6 columns E and F with columns G and H respectively). A comparable result was also obtained when cells were transfected with a transposon comprising a full length left transposon end with SEQ ID NO: 5 and truncated right transposon end with SEQ ID NO: 13 (compare Table 6 columns I and J with columns K and L respectively). A comparable result was also obtained when cells were transfected with a transposon comprising a full length left transposon end with SEQ ID NO: 5 and truncated right transposon end with SEQ ID NO: 14 (compare Table 6 columns M and N with columns O and P respectively). A comparable result was also obtained when cells were transfected with a transposon comprising a full length left transposon end with SEQ ID NO: 5 and truncated right transposon end with SEQ ID NO: 15 (compare Table 6 columns Q and R with columns S and T respectively). This shows that in addition to an integration target sequence immediately adjacent to a transposon ITR sequence with SEQ ID NO: 7, an *Oryzias* synthetic transposon left transposon end may further comprise an additional sequence selected from SEQ ID NOs: 5, 11 and 12 immediately adjacent to the left transposon ITR sequence; and an *Oryzias* synthetic transposon right transposon end may comprise an additional sequence selected from SEQ ID NOs: 6, 13, 14 and 15 immediately adjacent to a right transposon ITR sequence with SEQ ID NO: 8.

6.1.6 Engineering Hyperactive *Oryzias* Transposases

To identify *Oryzias* transposase mutations that led to either increased transposition activity, or increased excision activity, relative to the naturally occurring *Oryzias* transposase sequence given by SEQ ID NO: 782, we analyzed a CLUSTAL alignment of active piggyBac-like transposases. Table 1 column C shows the amino acids found in active piggyBac-like transposases relative to each position in the *Oryzias* transposase (position shown in Table 1 column A). The amino acid present in *Oryzias* transposase given by SEQ ID NO: 782 is shown in column B of Table 1. Because transposases are often deleterious to their hosts, they tend to accumulate mutations that inactivate them. The mutations that accumulate in different transposases are different, as each occurs by random chance. A consensus sequence can therefore be used to approximate an ancestral sequence that pre-dates the accumulation of deleterious mutations. It is difficult to accurately calculate an ancestral sequence from a small number of extant sequences, so we chose to focus on positions where active transposases were more highly conserved, and where the consensus amino acid(s) differed from the one in the *Oryzias* transposase. We considered that mutating these amino acids to the consensus amino acids found in other active transposases would be likely to increase the activity of the *Oryzias* transposase. These candidate beneficial amino acid substitutions are shown in Table 1 column D.

6.1.6.1 First Set of *Oryzias* Transposase Variants

A set of 95 polynucleotides encoding variant *Oryzias* transposases comprised one or more substitutions selected from E22D, D82K, A124C, Q131D, L138V, F149R, L156T, D160E, Y164F, I167L, A171T, G172A, R175K, K177N, G178R, L200R, T202R, I206L, I210L, N214D, W237F, V251L, V253I, V258L, M270I, 281F, A284L, M319L, G322P, L323V, H326R, F333W, Y337I, L361I, V386I, M400L, T402S, H404D, S408E, L409I, D422F, K435Q, Y440M, F455Y, V458L, D459N, S461A, A465S, V467I, L468I, W469Y, A512R, A514R, V515I, S524P, R548K, D549K, D550R, S551R and N562K. Each substitution was represented at least 5 times within the set of 95 variants, and the number of different pairwise combinations of substitutions was maximized so that each substitution was tested in as many different sequence contexts as possible. Each variant gene was cloned into a vector comprising a leucine selectable marker; each gene encoding a transposase variant was operably linked to the *Saccharomyces cerevisiae* Gal-1 promoter. Each of these variants was then individually transformed into a *Saccharomyces cerevisiae* strain comprising a chromosomally integrated copy of SEQ ID NO: 41, as described above. After 48 hours cells were scraped from the plate into minimal media lacking leucine and with galactose as the carbon source. The A600 for each culture was adjusted to 2. Cultures were grown for 4 hours in galactose to induce expression of the transposases, then a 1,000×-diluted aliquot was plated on media lacking leucine, uracil and tryptophan (to count transposition), a 1,000×-diluted aliquot was plated on media lacking leucine and uracil (to count excision) and a 25,000×-diluted aliquot was plated on media lacking leucine (to count total live cells). Two days later, colonies were counted to determine transposition (=number of cells on−leu-ura-trp media divided by (25×number of cells on−leu media)) and excision (=number of cells on−leu-ura media divided by (25×number of cells on−leu media)) frequencies. The results are shown in Table 7. Over 60 of the *Oryzias* transposase variants (with sequences given by SEQ ID NO: 816-877) possessed excision or transposition activities that were at least 10% of the activities measured for the naturally occurring *Oryzias* transposase; although not as active as the naturally occurring transposase these are still all highly active and useful transposases for the integration of an *Oryzias* transposon into the genome of a target eukaryotic cell. Some *Oryzias* transposases with activities shown in Table 7 are hyperactive for excision relative to the activity of SEQ ID NO: 782. Exemplary *Oryzias* transposases hyperactive for excision comprise a sequence selected from SEQ ID NO: 805-815. These are all functional non-natural *Oryzias* transposases.

The effects of sequence changes on excision and transposition frequencies were modelled as described in U.S. Pat. No. 8,635,029 and Liao et al (2007, BMC Biotechnology 2007, 7:16 doi:10.1186/1472-6750-7-16 "Engineering proteinase K using machine learning and synthetic genes"). Mean values and standard deviations for the regression weights were calculated for each substitution, these are shown in Table 8. The effect of an individual substitution upon transposase activity may vary depending on the context (ie the other substitutions present). A positive mean regression weight indicates that on average, considering all of the different sequence contexts in which it has been tested, the substitution has a positive influence on the measured property. Incorporation of substitutions with positive mean regression weights into a sequence generally results in variants with improved activity (Liao et. al., ibid). A further measure of the context-dependent variability of the effects of a substitution is the standard deviation of the regression weight. If the mean regression weight for a substitution minus the standard deviation of regression weight for that substitution is zero or greater, then the substitution has a positive effect in the majority of contexts. Thirty-one of the sixty substitutions we selected by looking for changes toward the consensus in other active piggyBac-like transposases had a mean regression weight minus the standard deviation of the regression weight for excision or transposition of zero or greater: E22D, A124C, Q131D, L138V, D160E, Y164F, I167L, A171T, R175K, T202R, I206L, I210L, N214D, V253I, V258L, I281F, A284L, V386I, M400L, S408E, L409I, F455Y, V458L, V467I, L468I, A514R, V515I, R548K, D549K, D550R and S551R (Table 8 columns F and I). Thirty-six substitutions we selected by looking for changes toward the consensus in other active piggyBac-like transposases had a mean regression weight greater than zero: E22D, A124C, Q131D, L138V, F149R, L156T, D160E, Y164F, I167L, A171T, R175K, K177N, T202R, I206L, I210L, N214D, V253I, V258L, I281F, A284L, L361I, V386I, M400L, S408E, L409I, F455Y, V458L, V467I, L468I, A514R, V515I, S524P, R548K, D549K, D550R and S551R. In addition to identifying specific substitutions with a beneficial effect, this also provides an indication of positions at which analogous substitutions may be beneficial. Analogous substitutions are those in which properties of the amino acids are conserved. For example: glycine and alanine are in the "small" amino acid group; valine, leucine, isoleucine and methionine are in the "hydrophobic" amino acid group; phenylalanine, tyrosine and tryptophan are in the "aromatic" amino acid group; aspartate and glutamate are in the "acidic" amino acid group; asparagine and glutamine are in the "amide" amino acid group; histidine, lysine and arginine are in the "basic" amino acid group; cysteine, serine and threonine are in the "nucleophilic" amino acid group. If a substitution at an amino acid position within the *Oryzias* transposase is beneficial for excision or transposition activity, other substitutions at the same position drawn from the same amino acid group are likely to be beneficial. For example, since replacing the nucleophilic residue serine at position 408 with the acidic residue glutamate (S408E) is beneficial, replacing with the acidic residue aspartate (i.e. S408D) is likely also to be beneficial. Similarly, since replacing the hydrophobic residue valine at position 258 with the hydrophobic residue leucine (V258L) is beneficial, replacing with the hydrophobic residues isoleucine or methionine (i.e. V258I or V258M) are likely also to be beneficial. An advantageous hyperactive *Oryzias* transposase comprises an amino acid substitution at one or more positions selected from amino acid 22, 124, 131, 138, 160, 164, 167, 171, 175, 202, 206, 210, 214, 253, 258, 281, 284, 386, 400, 408, 409, 455, 458, 467, 468, 514, 515, 548, 549, 550 and 551 relative to the sequence of SEQ ID NO: 782, for example one or more amino acid substitutions selected from E22D, A124C, Q131D, L138V, D160E, Y164F, I167L, A171T, R175K, T202R, I206L, I210L, N214D, V253I, V258L, I281F, A284L, V386I, M400L, S408E, L409I, F455Y, V458L, V467I, L468I, A514R, V515I, R548K, D549K, D550R and S551R, or an analogous substitution at one of these positions.

Table 8 also shows that some substitutions have positive regression weights for excision, but much less positive, or even negative weights for integration. These include amino acid substitutions L156T, Y164F, I167L, A171T, R175K, K177N, A284L and F455Y. Such substitutions may be combined to engineer an *Oryzias* transposase that has stronger excision than transposition activities. An advantageous *Oryzias* transposase hyperactive for excision comprises an amino acid substitution at one or more positions selected from amino acid 156, 164, 167, 171, 175, 177, 284 and 455 relative to the sequence of SEQ ID NO: 782, for example one or more amino acid substitutions selected from L156T, Y164F, I167L, A171T, R175K, K177N, A284L and F455Y, or an analogous substitution at one of these positions.

6.1.6.2 Second Set of *Oryzias* Transposase Variants

As described in Liao et al (2007, BMC Biotechnology 2007, 7:16 doi:10.1186/1472-6750-7-16 "Engineering proteinase K using machine learning and synthetic genes"), and U.S. Pat. No. 8,635,029, Sections 5.4.2 and 5.4.3, substitutions that have been tested several times in the contexts of different combinations of other substitutions and that have "a positive regression coefficient, weight or other value describing its relative or absolute contribution to one or more activity" of a protein are usefully incorporated into a protein to obtain a protein that is "improved for one or more property, activity or function of interest". Based on the substitution weights shown in Table 8, we designed a set of open reading frames encoding 31 new variants (with sequences given by SEQ ID NOs: 878-908) combining some of the most positive substitutions (L156T, Y164F, I167L, R175K, K177N, I210L, V258L, A284L, V386I L409I, F455Y, V458L, A465S, A514R and D550R). Each substitution was represented at least 5 times within the set of 31 variants, and the number of different pairwise combinations of substitutions was maximized so that each substitution was tested in as many different sequence contexts as possible. Each variant open reading frame was cloned into a vector comprising a leucine selectable marker; each open reading frame encoding a transposase variant was operably linked to the *Saccharomyces cerevisiae* Gal-1 promoter. Each of these variants was then individually transformed into a *Saccharomyces cerevisiae* strain comprising a chromosomally integrated copy of SEQ ID NO: 41, as described in Section 6.1.6.1. After 48 hours cells were scraped from the plate into minimal media lacking leucine and with galactose as the carbon source. The A600 for each culture was adjusted to 2. Cultures were grown for 4 hours in galactose to induce expression of the transposases, then a 25,000×-diluted aliquot was plated on media lacking leucine, uracil and tryptophan (to count transposition) and a 25,000×-diluted aliquot was plated on media lacking leucine (to count total live cells). Two days later, colonies were counted to determine transposition (=number of cells on–leu-ura-trp media divided by (number of cells on–leu media)) frequencies. The results are shown in Table 9.

In addition to the activities of the 31 new *Oryzias* transposase variants, Table 9 also shows the activities of 1 variant from the first set that was the most active variant in that set. The activities of the new set of variants were substantially higher than the first set. No variant was inactive, the lowest activity observed (for SEQ ID NO: 899) was 42% of the activity of SEQ ID NO: 782, and several variants had greater transposition activity than the naturally occurring *Oryzias* transposase (SEQ ID NOs: 853, 885, 903 and 905). A preferred *Oryzias* transposase comprises an amino acid substitution selected from L156T, Y164F, I167L, R175K, K177N, I210L, V258L, A284L, V386I L409I, F455Y, V458L, A465S, A514R and D550R, or analogous changes at the same positions.

Brief Description of Tables

Table 1. Amino Acid Changes Likely to Result in Enhanced Transposase Activity.

Amino acid substitutions with the potential to improve transposase activity were identified as described in Section 5.2.6. Column A shows the position in an *Oryzias* transposase (relative to SEQ ID NO: 782), column B shows the amino acid in the native protein, column C shows the amino acids found in known active piggyBac-like transposases at the equivalent position in an alignment, column D shows amino acid changes found in known active piggyBac-like transposases other than the *Oryzias* transposase at positions where there is good conservation within the rest of the transposase set, but the amino acid in the *Oryzias* transposase sequence is an outlier. Mutation to these amino acids are particularly likely to result in enhanced transposase activity. More than one amino acid letter in column means that each of those individual amino acid substitutions are acceptable or beneficial, it is not intended to represent a peptide. For example, at position 2, amino acids T, A, R, D or N are all acceptable, so column C contains "TARDN" to indicate this.

Table 2. Excision and Transposition of Transposons in Yeast.

Transposon and transposase sources are listed in column A. The left sequence with SEQ ID NO shown in column B and the right sequence with SEQ ID NO shown in column C were used to construct reporter plasmids as described in Section 6.1.2. The reporter plasmids have insert sequence given by the SEQ ID NO listed in column D. These reporter plasmids were integrated into the Ura3 gene of a Trp-strain of *Saccharomyces cerevisiae*. The amino acid sequence given by the SEQ ID NO shown in column E was back-translated, synthesized and cloned into a plasmid comprising a Leu2 gene expressible in *Saccharomyces cerevisiae* and 2 micron origin of replication. The transposase gene was operably linked to a Gal1 promoter. The plasmid comprising the transposase was transformed into the reporter strain, expression was induced, and cells were plated as described in Section 6.1.1. Induced culture was diluted 25,000-fold prior to plating 100 µl on leu dropout plates, and 100-fold prior to plating 100 µl on leu ura or leu ura trp dropout plates. Column F shows the number of colonies on the leu dropout plates; column G shows the number of colonies on the leu ura dropout plates (indicating excision of the transposon from the middle of the ura gene in the reporter); column H shows the number of colonies on the leu ura trp dropout plates (indicating excision of the transposon from the middle of the ura gene in the reporter and transposition to another site in the genome).

Table 3. Transposition of Transposons into the Genome of CHO Target Cells.

Cells were transfected with transposon SEQ ID NO: 108 as described in Section 6.1.3. The transposase SEQ ID NO is shown in row 1. For each transfection, viability (the percentage of cells that are viable) and the total viable cell density (in millions of cells per ml) are shown in adjacent columns, as indicated in row 2. Rows 3-17 show these measurements at various times post-transfection, the days elapsed are shown in column A.

Table 4. Antibody Production from Transposons Integrated into the Genome of CHO Target Cells.

Cells were transfected with transposons and transposases as described in Section 6.1.3. Recovery is shown in Table 3. During a 14 day fed batch antibody production run, the culture supernatant contained the concentration of antibody (antibody titer) shown: column A shows the titer on Day 7; column B shows the titer on Day 10; column C shows the titer on Day 12; column D shows the titer on Day 14.

Table 5. Transposition of Transposons into the Genome of CHO Target Cells by mRNA-Encoded Transposase.

Cells were transfected with a transposon and mRNA-encoded transposase as described in Section 6.1.4. The viability (the percentage of cells that are viable) and the total viable cell density (in millions of cells per ml) are shown in adjacent columns, as indicated in row 3. Rows 1-12 show these measurements at various times post-transfection, the days elapsed since transfection are shown in column A.

Table 6. Transposition of Transposons with Truncated End Sequences into the Genome of CHO Target Cells.

Cells were transfected with a transposon and optionally an mRNA-encoded transposase as described in Section 6.1.5. The transposon SEQ ID NO is shown in row 1. Each transposon comprised a left transposon end comprising a 5'-TTAA-3' integration target sequence immediately adjacent to a transposon ITR sequence with SEQ ID NO: 9 which was immediately adjacent to (followed by) a left end sequence with SEQ ID NO shown in row 2. The transposon further comprised SEQ ID NO: 42: an open reading frame encoding a glutamine synthetase selectable marker operably linked to regulatory sequences expressible in a mammalian cell. The transposon further comprised a right transposon end comprising a right end sequence with SEQ ID NO shown in row 3 immediately adjacent to a transposon ITR sequence with SEQ ID NO: 10 which was immediately adjacent to a 5'-TTAA-3' integration target sequence. Row 4 shows the SEQ ID NO of the transposase encoded by the transfected mRNA. The viability (the percentage of cells that are viable) is indicated in columns labelled "V %" in row 5 and the total viable cell density (in millions of cells per ml) is indicated in columns labelled "VCD" in row 5. Rows 6-15 show these measurements at various times post-transfection, the days elapsed since transfection are shown in column U.

Table 7. Transposition and Excision Activities of *Oryzias* Transposase Variants.

Genes encoding *Oryzias* transposase variants were designed, synthesized and cloned as described in Section 6.1.6.1. SEQ ID NOs of each variant are given in column A. Genes were transformed into a *Saccharomyces cerevisiae* strain whose genome comprised a single copy of transposase reporter SEQ ID NO: 41, and plated on media lacking leucine. After 48 hours cells were scraped from the plate into minimal media lacking leucine and with galactose as the carbon source. The A600 for each culture was adjusted to 2. Cultures were grown for 4 hours in galactose to induce expression of the transposases. Cultures were diluted 1,000-fold into minimal media lacking leucine; one 100 µl aliquot was plated onto minimal media agar plates lacking leucine and uracil (to measure transposon excision) another 100 µl aliquot was plated onto minimal media agar plates lacking leucine, tryptophan and uracil (to measure transposon transposition). Each culture was also diluted 25,000-fold and a 100 µl aliquot was plated onto minimal media agar plates lacking leucine (to measure live cells). After 48 hours colonies on each plate were counted, the number of colonies on plates lacking leucine are shown in column B, the number of colonies on plates lacking leucine and uracil are shown in column C, the number of colonies on plates lacking leucine, uracil and tryptophan are shown in column D. Column E shows the excision frequency (calculated as the number in column C, divided by the number in column B, and further divided by 25). Column F shows the transposition frequency (calculated as the number in column D, divided by the number in column B, and further divided by 25)

Table 8. Model Weights for Amino Acid Substitutions in *Oryzias* Transposase Variants.

The effects of sequence changes on *Oryzias* transposase excision and transposition activities were modelled as described in U.S. Pat. No. 8,635,029. The mean values and standard deviations for the regression weights were calculated for each substitution. The position (relative to SEQ ID NO: 782) is shown in column A, the amino acid found at this position in SEQ ID NO: 782 is shown in column B. The tested amino acid substitution is shown in column C. The regression weight for the substitution on transposition activity is shown in column D, the standard deviation for this regression weight is shown in column E, the mean weight minus the standard deviation is shown in column F. The regression weight for the substitution on excision activity is shown in column G, the standard deviation for this regression weight is shown in column H, the mean weight minus the standard deviation is shown in column I.

Table 9. Transposition and Excision Activities of *Oryzias* Transposase Variants.

Genes encoding *Oryzias* transposase variants were designed, synthesized and cloned as described in Section 6.1.6.2. SEQ ID NOs of each variant are given in column A. Genes were transformed into a *Saccharomyces cerevisiae* strain whose genome comprised a single copy of transposase reporter SEQ ID NO: 41 and plated on media lacking leucine. After 48 hours cells were scraped from the plate into minimal media lacking leucine and with galactose as the carbon source. The A600 for each culture was adjusted to 2. Cultures were grown for 4 hours in galactose to induce expression of the transposases. Cultures were diluted 25,000-fold into minimal media lacking leucine; one 100 µl aliquot was plated onto minimal media agar plates lacking leucine and uracil (to measure transposon excision) another 100 µl aliquot was plated onto minimal media agar plates lacking leucine, tryptophan and uracil (to measure transposon transposition) and a third 100 µl aliquot was plated onto minimal media agar plates lacking leucine (to measure live cells). After 48 hours colonies on each plate were counted, the number of colonies on plates lacking leucine are shown in column B, the number of colonies on plates lacking leucine and uracil are shown in column C, the number of colonies on plates lacking leucine, uracil and tryptophan are shown in column D. Column E shows the excision frequency (calculated as the number in column C, divided by the number in column B). Column F shows the transposition frequency (calculated as the number in column D, divided by the number in column B).

TABLES

TABLE 1

| A oryzias_position | B oryzias | C Acceptable | D Beneficial |
|---|---|---|---|
| 1 | M | EM | |
| 2 | S | PSEAG | |
| 3 | S | SMK | |
| 4 | R | TARDN | |
| 5 | R | SRQFI | |
| 6 | F | SGFRLYE | |
| 7 | T | GLTDSRA | |
| 8 | A | RTANDQ | |
| 9 | E | KDEQH | |
| 10 | E | RLEDHN | |
| 11 | A | SEAIR | |
| 12 | L | ILA | |
| 13 | L | GNLASR | |
| 14 | L | NQLTAH | |
| 15 | F | VIFLCM | |
| 16 | F | HLFM | HLM |
| 17 | D | NEDQA | |
| 18 | S | QLSNE | |
| 19 | D | REDSV | |
| 20 | A | ADSLE | |
| 21 | E | AVEDST | |
| 22 | E | KEYLD | |

TABLE 1-continued

| A oryzias_position | B oryzias | C Acceptable | D Beneficial |
|---|---|---|---|
| 23 | E | NESVFY | |
| 24 | I | RDIPGS | |
| 25 | S | RVSLEGDY | |
| 26 | E | AIEDS | |
| 27 | I | VFISD | |
| 28 | E | VDES | |
| 29 | D | ED | |
| 30 | L | SLY | |
| 31 | S | PGSVE | |
| 32 | D | GDEP | |
| 33 | A | TEAKVP | |
| 34 | E | RSEAT | |
| 35 | D | DS | |
| 36 | N | FHNRCE | |
| 37 | D | GVDSC | |
| 38 | I | TSIVD | |
| 39 | D | TIDES | |
| 40 | D | LRDSH | |
| 41 | P | TPDEN | |
| 42 | D | SVDE | |
| 43 | F | WEFQN | |
| 44 | Q | LSQY | LSY |
| 45 | F | DFW | D |
| 46 | S | NTSC | |
| 47 | D | EDS | E |
| 48 | D | DESQ | |
| 49 | E | SVEA | |
| 50 | E | SEMIFTRA | |
| 51 | D | GIDV | |
| 52 | S | SPD | |
| 53 | E | ETYFASP | |
| 54 | D | VLD | V |
| 55 | E | EHD | |
| 56 | S | DPSEVL | |
| 57 | A | SA | |
| 58 | V | DQVNE | |
| 59 | V | TQVNIME | |
| 60 | S | IGSLET | |

TABLE 1-continued

| A oryzias_position | B oryzias | C Acceptable | D Beneficial |
|---|---|---|---|
| 61 | P | SPADVY | |
| 62 | S | QSED | |
| 63 | D | SDQRE | |
| 64 | E | ESNDP | |
| 65 | N | SENVD | |
| 66 | L | ENLAPID | |
| 67 | G | EDGN | |
| 68 | M | QMLV | |
| 69 | E | VPE | |
| 70 | Q | ALQVGD | |
| 71 | S | DSTQ | |
| 72 | S | HNSELA | |
| 73 | S | VLSA | |
| 74 | T | TAGR | |
| 75 | E | ERSDQ | |
| 76 | G | ERGHN | |
| 77 | T | HSTRAM | |
| 78 | W | NWIDSF | |
| 79 | A | MAILC | |
| 80 | S | STA | |
| 81 | K | SKLAR | |
| 82 | D | DPGQ | |
| 83 | G | NDG | |
| 84 | N | RNKEG | |
| 85 | I | YTIHP | |
| 86 | K | KIVCA | |
| 87 | W | W | |
| 88 | S | ANSGY | |
| 89 | T | CRTPK | |
| 90 | S | QASTPN | |
| 91 | P | PKC | |
| 92 | H | LPHGSNQ | |
| 93 | Q | SNQRTF | |
| 94 | S | RPST | |
| 95 | R | ARTN | |
| 96 | G | VGSI | |
| 97 | R | R | |
| 98 | L | VTL | |
| 99 | S | PRS | |

TABLE 1-continued

| oryzias_position | oryzias | Acceptable | Beneficial |
|---|---|---|---|
| 100 | S | QSAE | |
| 101 | S | HESIL | |
| 102 | N | NP | |
| 103 | I | IP | |
| 104 | I | IVF | |
| 105 | K | QTKR | |
| 106 | M | RGMTSE | |
| 107 | T | TNQVR | |
| 108 | P | NPRA | |
| 109 | G | VGQL | |
| 110 | P | SVP | |
| 111 | T | NKT | |
| 112 | R | LRVNT | |
| 113 | F | TQFMDIG | |
| 114 | A | EACT | |
| 115 | V | DKVRS | |
| 116 | T | DNT | DN |
| 117 | R | R | |
| 118 | V | PAVI | |
| 119 | D | KLDVYFS | |
| 120 | D | DLET | |
| 121 | I | PEI | PE |
| 122 | Q | FLQIYS | |
| 123 | S | SDLNEK | |
| 124 | A | ICAF | ICF |
| 125 | F | WF | |
| 126 | Q | NHQK | |
| 127 | L | KLI | |
| 128 | F | LF | |
| 129 | I | MVIF | |
| 130 | S | DNST | DNT |
| 131 | Q | DEQS | |
| 132 | P | ESPAD | |
| 133 | I | IM | |
| 134 | E | LEI | LI |
| 135 | R | QSRHD | |
| 136 | I | EVID | DEV |
| 137 | I | TIM | |
| 138 | L | LV | |
| 139 | D | KEDLT | |
| 140 | M | WHMY | |
| 141 | T | T | |
| 142 | N | N | |
| 143 | L | EHLVAS | |
| 144 | E | KEYS | |
| 145 | G | IGMA | IMA |
| 146 | R | IRSE | |
| 147 | R | QSRVLH | |
| 148 | V | YEVKRS | |
| 149 | F | RFLQ | |
| 150 | Q | SQRTV | |
| 151 | E | PYEAHFV | |
| 152 | K | EAKSTYH | |
| 153 | W | LYWFMK | |
| 154 | K | RSKHQ | |
| 155 | S | NESDP | |
| 156 | L | LTI | |
| 157 | D | DTN | |
| 158 | Q | MLQTEI | |
| 159 | T | VTMDACS | |
| 160 | D | ED | E |
| 161 | L | LMI | |
| 162 | N | HRNWYK | |
| 163 | A | AR | |
| 164 | Y | FVYL | |
| 165 | I | IVF | |
| 166 | G | GA | |
| 167 | I | LI | |
| 168 | L | LT | |
| 169 | I | LYITV | |
| 170 | L | FLMAI | |
| 171 | A | TAM | |
| 172 | G | AG | |
| 173 | V | VL | |
| 174 | Y | FYMRIT | |
| 175 | R | KR | K |
| 176 | S | SDA | |

TABLE 1-continued

| oryzias_position | oryzias | Acceptable | Beneficial |
|---|---|---|---|
| 177 | K | NGK | N |
| 178 | G | HRG | |
| 179 | E | EQLMS | |
| 180 | A | NASL | |
| 181 | T | VLTE | |
| 182 | S | NQSDK | |
| 183 | S | YDSE | |
| 184 | L | LW | |
| 185 | W | FWD | |
| 186 | N | ANDTR | |
| 187 | E | DETS | |
| 188 | E | GEFLV | |
| 189 | N | TNSL | |
| 190 | G | GS | |
| 191 | R | RIV | |
| 192 | P | EPTMD | |
| 193 | I | IRV | |
| 194 | F | FY | |
| 195 | R | RPVS | |
| 196 | A | CMAST | |
| 197 | T | VT | |
| 198 | M | M | |
| 199 | S | S | |
| 200 | L | KLR | |
| 201 | E | NREDQ | |
| 202 | T | RT | R |
| 203 | F | FY | |
| 204 | H | LAHEDQY | |
| 205 | M | VFML | VFL |
| 206 | I | IL | |
| 207 | S | LVSIQ | |
| 208 | R | HNR | |
| 209 | V | CVFNS | |
| 210 | I | LIM | |
| 211 | R | RH | |
| 212 | F | FM | |
| 213 | D | DN | |
| 214 | N | ND | |

TABLE 1-continued

| oryzias_position | oryzias | Acceptable | Beneficial |
|---|---|---|---|
| 215 | R | PSRKT | |
| 216 | D | DTSA | |
| 217 | T | DTLIV | |
| 218 | R | RP | |
| 219 | V | EVPD | |
| 220 | G | EGTD | |
| 221 | R | RLQ | |
| 222 | R | RAPK | |
| 223 | E | EASGQK | |
| 224 | S | SIDNHT | |
| 225 | D | D | |
| 226 | K | KRAVN | |
| 227 | L | ILFM | |
| 228 | A | AILTH | |
| 229 | A | APK | |
| 230 | I | IVLF | |
| 231 | R | SR | |
| 232 | D | YQDKPS | |
| 233 | V | IVLM | |
| 234 | W | FYWI | |
| 235 | D | TED | |
| 236 | K | KEILSQ | |
| 237 | W | FWL | F |
| 238 | V | VIS | |
| 239 | E | GKENHQ | |
| 240 | I | NIQRC | |
| 241 | L | CLF | C |
| 242 | P | QKPRIA | |
| 243 | L | KDLQAN | |
| 244 | L | IVLNA | |
| 245 | Y | YH | |
| 246 | N | NTVS | |
| 247 | P | VP | |
| 248 | G | CYGS | |
| 249 | P | EPGSAQ | |
| 250 | H | YNHF | |
| 251 | V | ALVI | ALI |
| 252 | T | TC | |
| 253 | V | VI | |

TABLE 1-continued

| oryzias_position | oryzias | Acceptable | Beneficial |
|---|---|---|---|
| 254 | D | D | |
| 255 | E | E | |
| 256 | R | MERQS | |
| 257 | L | L | |
| 258 | V | VL | |
| 259 | P | PAGLS | |
| 260 | F | F | |
| 261 | R | RK | |
| 262 | G | G | |
| 263 | R | R | |
| 264 | C | TCL | |
| 265 | P | HKPQL | |
| 266 | F | LF | |
| 267 | R | MR | |
| 268 | Q | IQMV | |
| 269 | Y | Y | |
| 270 | M | MLI | |
| 271 | P | P | |
| 272 | N | MNS | |
| 273 | K | K | |
| 274 | P | PR | |
| 275 | A | ADS | |
| 276 | K | KR | |
| 277 | Y | Y | |
| 278 | G | G | |
| 279 | I | LI | |
| 280 | K | KR | |
| 281 | I | LIF | |
| 282 | W | MIWPLYF | |
| 283 | A | CAMK | |
| 284 | A | LAM | LM |
| 285 | C | CV | |
| 286 | D | DAE | |
| 287 | A | AS | |
| 288 | K | NYKAGS | |
| 289 | S | NTS | |
| 290 | S | GYSKF | |
| 291 | Y | Y | |

TABLE 1-continued

| oryzias_position | oryzias | Acceptable | Beneficial |
|---|---|---|---|
| 292 | A | FSAMTV | |
| 293 | W | YLWISV | |
| 294 | K | NKDY | |
| 295 | M | CMAGFL | |
| 296 | Q | YEQIML | |
| 297 | V | IVP | |
| 298 | Y | Y | |
| 299 | T | TALE | |
| 300 | G | G | |
| 301 | K | RDK | |
| 302 | S | GQSD | |
| 303 | P | SPT | |
| 304 | G | DGKQSL | |
| 305 | G | GTL | |
| 306 | A | APND | |
| 307 | P | GYP | |
| 308 | E | LKEVPA | |
| 309 | K | TVKPG | |
| 310 | N | ESNC | |
| 311 | Q | ENQP | |
| 312 | G | PGSA | |
| 313 | M | THMEGF | |
| 314 | R | QDRFYKE | |
| 315 | V | SVYI | |
| 316 | V | V | |
| 317 | L | IDLKWE | |
| 318 | E | HRED | |
| 319 | M | LIM | L |
| 320 | S | AVSTI | |
| 321 | E | KQES | |
| 322 | G | PGT | P |
| 323 | L | LIV | |
| 324 | Q | FSQHLA | |
| 325 | G | GQR | |
| 326 | H | RHF | R |
| 327 | N | NH | |
| 328 | I | IVL | |
| 329 | T | TY | |
| 330 | C | CMVF | |

TABLE 1-continued

| A oryzias_position | B oryzias | C Acceptable | D Beneficial |
|---|---|---|---|
| 331 | D | D | |
| 332 | N | N | |
| 333 | F | WF | |
| 334 | F | FY | |
| 335 | T | TS | |
| 336 | S | SG | |
| 337 | Y | IY | |
| 338 | R | EPRT | |
| 339 | L | LT | |
| 340 | G | IYGAFM | |
| 341 | E | EAKTL | |
| 342 | E | YHENA | |
| 343 | L | LM | |
| 344 | Q | KLQY | KLY |
| 345 | K | KQCN | |
| 346 | R | KNRAEL | |
| 347 | K | GKNDR | |
| 348 | L | LT | |
| 349 | T | TP | |
| 350 | M | CAMIS | |
| 351 | L | VLCT | VCT |
| 352 | G | G | |
| 353 | T | T | |
| 354 | V | MVI | |
| 355 | R | KRN | |
| 356 | R | KSR | |
| 357 | N | N | |
| 358 | K | KR | |
| 359 | P | RTPK | RTK |
| 360 | E | ECGQ | |
| 361 | L | ILM | |
| 362 | P | P | |
| 363 | S | KPSERD | |
| 364 | E | EKVAS | |
| 365 | I | FIL | |
| 366 | L | LRKIT | |
| 367 | K | PEKNDR | |
| 368 | I | SRIKT | |
| 369 | Q | KQRDG | |
| 370 | G | QGSL | |
| 371 | R | RN | |
| 372 | P | DEPRQ | |
| 373 | M | VIMGP | |
| 374 | H | GNHEA | |
| 375 | S | ST | |
| 376 | S | SY | |
| 377 | I | LIMAV | |
| 378 | F | YFL | |
| 379 | A | GACR | |
| 380 | F | YFK | |
| 381 | T | AQTDN | |
| 382 | E | GDEK | |
| 383 | K | QDKPL | |
| 384 | A | NFALI | |
| 385 | T | TA | |
| 386 | V | IVL | IL |
| 387 | V | LVK | |
| 388 | S | SF | |
| 389 | Y | HYF | |
| 390 | C | VICKDA | |
| 391 | P | P | |
| 392 | K | K | |
| 393 | R | KRP | |
| 394 | N | NSAK | |
| 395 | K | KR | |
| 396 | N | ANMV | |
| 397 | V | V | |
| 398 | L | IFLYV | |
| 399 | V | LMVA | |
| 400 | M | LM | |
| 401 | S | ST | |
| 402 | T | ST | |
| 403 | M | MLCI | |
| 404 | H | HD | |
| 405 | T | HTED | |
| 406 | D | ADNE | |
| 407 | A | ESAN | |

TABLE 1-continued

| A oryzias_position | B oryzias | C Acceptable | D Beneficial |
|---|---|---|---|
| 408 | S | AESV | |
| 409 | L | VIL | I |
| 410 | S | DSNR | |
| 411 | T | ESTQ | ESQ |
| 412 | R | TERSQ | |
| 413 | D | TDNR | |
| 414 | D | GDV | G |
| 415 | M | QMN | |
| 416 | K | K | |
| 417 | P | P | |
| 418 | Q | ESQDL | |
| 419 | M | IMC | |
| 420 | I | IVS | |
| 421 | L | GTLMK | |
| 422 | D | FDYE | FYE |
| 423 | Y | Y | |
| 424 | N | NS | |
| 425 | S | KSQ | |
| 426 | T | TY | |
| 427 | K | KM | |
| 428 | G | GSA | |
| 429 | G | G | |
| 430 | V | V | |
| 431 | D | D | |
| 432 | N | ENSTRV | |
| 433 | L | IVLFT | |
| 434 | D | D | |
| 435 | K | KQE | |
| 436 | V | KLVM | |
| 437 | T | CITQS | |
| 438 | A | ARKSH | |
| 439 | T | ITSVYN | |
| 440 | Y | YM | |
| 441 | S | TDSN | |
| 442 | C | SVCA | |
| 443 | Q | SQNT | |
| 444 | R | R | |
| 445 | K | RNK | |
| 446 | T | TS | |
| 447 | A | RANK | |
| 448 | R | RA | |
| 449 | W | W | |
| 450 | P | PY | |
| 451 | M | MLK | |
| 452 | A | VTAK | |
| 453 | I | VIL | |
| 454 | F | FLG | |
| 455 | F | YFI | |
| 456 | N | RWNGY | |
| 457 | I | MILV | |
| 458 | V | LVI | LI |
| 459 | D | DNQ | |
| 460 | V | ITVM | |
| 461 | S | SA | |
| 462 | A | TGAFCLS | |
| 463 | Y | VIYR | |
| 464 | N | N | |
| 465 | A | SA | |
| 466 | Y | HKYFC | |
| 467 | V | LIV | I |
| 468 | L | IVL | IV |
| 469 | W | YQW | Y |
| 470 | S | DMSCKRQ | |
| 471 | E | ILEHAT | |
| 472 | I | HNIA | HNA |
| 473 | N | HSNKV | |
| 474 | Q | SQIPN | |
| 475 | E | DENSG | |
| 476 | W | WKP | |
| 477 | N | N | |
| 478 | A | AQG | |
| 479 | G | DGKE | |
| 480 | K | KNVA | |
| 481 | L | TLPV | |
| 482 | Y | TPYIQSV | |
| 483 | R | ETRNSYK | |
| 484 | R | RY | |

TABLE 1-continued

| A oryzias_position | B oryzias | C Acceptable | D Beneficial |
|---|---|---|---|
| 485 | R | GRKT | |
| 486 | L | MALEKY | |
| 487 | F | FQ | |
| 488 | L | LIM | |
| 489 | E | KERQ | |
| 490 | E | QKENIS | |
| 491 | L | L | |
| 492 | G | AGSYP | |
| 493 | K | RMKTIAL | |
| 494 | A | TSADQL | |
| 495 | L | LM | |
| 496 | I | VITF | |
| 497 | T | LATSGY | |
| 498 | P | PSGE | |
| 499 | K | QHKWFV | |
| 500 | I | MQIEL | |
| 501 | Q | KAQREH | |
| 502 | R | REKQS | |
| 503 | R | RT | |
| 504 | A | AKLVN | |
| 505 | R | LTRKQEP | |
| 506 | P | NPAEK | |
| 507 | A | ESAPMK | |
| 508 | R | RKTPN | |
| 509 | S | LISP | |
| 510 | P | PKS | |
| 511 | A | RVADTF | |
| 512 | A | ESATYNH | |
| 513 | A | LAVI | LVI |
| 514 | A | RA | |
| 515 | V | LKVDRQ | |
| 516 | I | SRINL | |
| 517 | E | LIE | I |
| 518 | K | AGKTSE | |
| 519 | I | RSINK | |
| 520 | K | VHKIQ | |
| 521 | F | LF | |
| 522 | R | GRKPI | |

TABLE 1-continued

| A oryzias_position | B oryzias | C Acceptable | D Beneficial |
|---|---|---|---|
| 523 | T | PETNKD | |
| 524 | S | DSVETP | |
| 525 | N | MSNVLT | |
| 526 | Q | PAQ | P |
| 527 | F | FPAG | |
| 528 | A | VSATR | |
| 529 | M | PMSH | |
| 530 | D | DAEGV | |
| 531 | P | PKND | |
| 532 | V | QIVNSM | |
| 533 | D | EPDSTR | |
| 534 | T | VNTE | |
| 535 | D | DE | |
| 536 | V | FVPM | |
| 537 | K | KG | |
| 538 | K | TVKPR | |
| 539 | R | RKQY | |
| 540 | K | RKSTV | |
| 541 | R | RYG | |
| 542 | C | C | |
| 543 | Q | HYQGTKR | |
| 544 | V | TIVFYDE | |
| 545 | C | C | |
| 546 | P | PSR | |
| 547 | S | LVSYKN | |
| 548 | R | KR | |
| 549 | D | LKDI | |
| 550 | D | QDR | |
| 551 | S | RS | R |
| 552 | K | KMD | |
| 553 | T | STA | |
| 554 | S | TKSNR | |
| 555 | T | HYTAR | |
| 556 | S | TISQY | |
| 557 | C | CF | |
| 558 | V | YIVCKPN | |
| 559 | K | TSKA | |
| 560 | C | C | |
| 561 | K | KTPA | |

TABLE 1-continued

| A<br>oryzias_position | B<br>oryzias | C<br>Acceptable | D<br>Beneficial |
|---|---|---|---|
| 562 | N | KSNR | KSR |
| 563 | F | HFAVNP | |
| 564 | I | VIL | |
| 565 | C | C | |
| 566 | R | LRGFM | |
| 567 | K | QEK | |
| 568 | H | CHP | |
| 569 | T | ATNC | |
| 570 | V | KNVIF | |
| 571 | T | QFTDE | |
| 572 | F | VFMIL | |
| 573 | C | CY | |
| 574 | P | AEPQH | |
| 575 | S | DNST | |
| 576 | C | CQ | |
| 577 | G | VRGIFLA | |
| 578 | E | REGHD | |
| 579 | H | NHYL | |

TABLE 2

| A<br>Source | B<br>Tposon left end | C<br>Tposon right end | D<br>Tposon SEQ ID NO. | E<br>Tpase SEQ ID NO. | F<br>leu | G<br>leu ura | H<br>leu ura trp |
|---|---|---|---|---|---|---|---|
| *Oryzias latipes* | 1 | 2 | 41 | 782 | 357 | 615 | 307 |
| *Spodoptera litura* | 68 | 69 | 48 | 21 | >250 | 0 | 0 |
| *Pieris rapae* | 70 | 71 | 49 | 22 | >250 | 0 | 0 |
| *Myzus persicae* | 72 | 73 | 50 | 23 | >250 | 0 | 0 |
| *Onthophagus taurus* | 74 | 75 | 51 | 24 | >250 | 0 | 0 |
| *Temnothorax curvispinosus* | 76 | 77 | 52 | 25 | >250 | 0 | 0 |
| *Agrilus planipenn* | 78 | 79 | 53 | 26 | >250 | 0 | 0 |
| *Parasteatoda tepidariorum* | 80 | 81 | 54 | 27 | >250 | 0 | 0 |
| *Pectinophora gossypiella* | 82 | 83 | 55 | 28 | >250 | 0 | 0 |
| *Ctenopusia agnata* | 84 | 85 | 56 | 29 | >250 | 0 | 0 |
| *Macrostomum lignano* | 86 | 87 | 57 | 30 | >250 | 0 | 0 |
| *Orussus abietinus* | 88 | 89 | 58 | 31 | >250 | 0 | 0 |
| *Eufriesea mexicana* | 90 | 91 | 59 | 32 | 323 | 0 | 0 |
| *Spodoptera litura* | 92 | 93 | 60 | 33 | 400 | 0 | 0 |
| *Vanessa tameamea* | 94 | 95 | 61 | 34 | 389 | 0 | 0 |
| *Blattella germanica* | 96 | 97 | 62 | 35 | 248 | 0 | 0 |
| *Onthophagus taurus* | 98 | 99 | 63 | 36 | >250 | 0 | 0 |
| *Onthophagus taurus* | 100 | 101 | 64 | 37 | >250 | 0 | 0 |
| *Onthophagus taurus* | 102 | 103 | 65 | 38 | >250 | 0 | 0 |
| *Megachile rotundata* | 104 | 105 | 66 | 39 | >250 | 0 | 0 |
| *Xiphophorus maculatus* | 106 | 107 | 67 | 40 | >250 | 0 | 0 |

TABLE 3

| | A | B | C | D | E |
|---|---|---|---|---|---|
| 1 | Transposase SEQ ID NO | none | none | 782 | 782 |
| 2 | Day | viability | viable cells | viability | viable cells |
| 3 | 1 | 94.12 | 1.03 | 90.45 | 0.86 |
| 4 | 3 | 92.15 | 0.55 | 93.49 | 0.34 |
| 5 | 5 | 80.66 | 0.22 | 87.18 | 0.59 |
| 6 | 7 | 57.58 | 0.05 | 86.49 | 0.63 |
| 7 | 10 | 27.18 | 0.03 | 93.31 | 2.84 |
| 8 | 12 | 27.05 | 0.04 | 97.52 | >3 |
| 9 | 13 | not measured | not measured | 97.19 | >3 |
| 10 | 14 | 31.88 | 0.04 | not measured | >3 |
| 11 | 17 | 41.46 | 0.04 | 99.16 | >3 |
| 12 | 18 | no live cells | no live cells | 98.99 | >3 |
| 13 | 19 | no live cells | no live cells | 99.50 | >3 |
| 14 | 21 | no live cells | no live cells | 99.25 | >3 |
| 15 | 24 | no live cells | no live cells | >99 | >3 |
| 16 | 26 | no live cells | no live cells | >99 | >3 |
| 17 | 27 | no live cells | no live cells | >99 | >3 |

TABLE 4

| | A<br>Day 7 | B<br>Day 10 | C<br>Day 12 | D<br>Day 14 |
|---|---|---|---|---|
| 1 Antibody titer | 1,150 | 1,876 | 1,994 | 1,972 |

TABLE 5

| | A<br>Days post-transfection | B<br>viability | C<br>viable cells |
|---|---|---|---|
| 1 | 1 | 93.47 | 0.84 |
| 2 | 2 | 92.09 | 0.12 |

TABLE 5-continued

|   | A<br>Days post-transfection | B<br>viability | C<br>viable cells |
|---|---|---|---|
| 3 | 5 | 81.46 | 0.15 |
| 4 | 7 | 53.09 | 0.05 |
| 5 | 9 | 28.46 | 0.04 |
| 6 | 14 | 34.23 | 0.05 |
| 7 | 16 | 46.06 | 0.08 |
| 8 | 19 | 48.06 | 0.06 |
| 9 | 21 | 61.74 | 0.22 |
| 10 | 23 | 65.34 | 0.37 |
| 11 | 26 | 92.66 | 0.52 |
| 12 | 28 | 96.50 | 3.05 |

TABLE 6

|   |   | A | B | C | D | E | F | G | H | I | J | K |
|---|---|---|---|---|---|---|---|---|---|---|---|---|
| 1 | SEQ ID of Transposon | 43 | 43 | 43 | 43 | 44 | 44 | 44 | 44 | 45 | 45 | 45 |
| 2 | Left end SEQ ID NO | 11 | 11 | 11 | 11 | 12 | 12 | 12 | 12 | 5 | 5 | 5 |
| 3 | Right end SEQ ID NO | 6 | 6 | 6 | 6 | 6 | 6 | 6 | 6 | 13 | 13 | 13 |
| 4 | Transposase SEQ ID NO | none | now | 782 | 782 | none | none | 782 | 782 | now | none | 782 |
| 5 |   | V % | VCD | V % | VCD | V % | VCD | V % | VCD | V % | VCD | V % |
| 6 |   | 91.3 | 0.85 | 94.6 | 0.86 | 97.4 | 1.39 | 98.3 | 0.91 | 95.3 | 1.08 | 96.2 |
| 7 |   | 95.7 | 0.47 | 84.5 | 0.47 | 95.5 | 0.41 | 91.5 | 0.44 | 95.5 | 0.32 | 80.5 |
| 8 |   | 88.4 | 0.76 | 60.7 | 0.49 | 88.4 | 0.43 | 70.0 | 0.46 | 86.2 | 0.35 | 62.7 |
| 9 |   | 77.2 | 0.23 | 53.4 | 0.21 | 72.2 | 0.20 | 51.7 | 0.18 | 69.3 | 0.17 | 51.6 |
| 10 |   | 62.2 | 0.18 | 40.7 | 0.16 | 51.2 | 0.12 | 35.9 | 0.13 | 39.7 | 0.06 | 33.5 |
| 11 |   | 36.7 | 0.15 | 34.7 | 0.25 | 34.2 | 0.10 | 32.0 | 0.11 | 27.3 | 0.06 | 24.5 |
| 12 |   | 23.0 | 0.04 | 47.4 | 0.23 | 17.8 | 0.04 | 27.5 | 0.10 | 25.2 | 0.05 | 31.7 |
| 13 |   | 11.8 | 0.02 | 82.3 | 1.27 | 14.8 | 0.02 | 51.5 | 0.32 | 16.8 | 0.03 | 60.0 |
| 14 |   | 11.4 | 0.02 | 95.4 | 2.33 | 8.0 | 0.01 | 75.4 | 0.97 | 10.0 | 0.02 | 79.1 |
| 15 |   | 5.9 | 0.01 | 99.3 | 4.11 | 19.5 | 0.05 | 97.8 | 2.27 | 8.5 | 0.01 | 98.3 |

|   |   | L | M | N | O | P | Q | R | S | T | U |
|---|---|---|---|---|---|---|---|---|---|---|---|
| 1 | SEQ ID of Transposon | 45 | 46 | 46 | 46 | 46 | 47 | 47 | 47 | 47 |   |
| 2 | Left end SEQ ID NO | 5 | 5 | 5 | 5 | 5 | 5 | 5 | 5 | 5 |   |
| 3 | Right end SEQ ID NO | 13 | 14 | 14 | 14 | 14 | 15 | 15 | 15 | 15 |   |
| 4 | Transposase SEQ ID NO | 782 | now | none | 782 | 782 | now | now | 782 | 782 |   |
| 5 |   | VCD | V % | VCD | V % | VCD | V % | VCD | V % | VCD | Step day sampled |
| 6 |   | 1.07 | 92.9 | 1.34 | 97.2 | 1.10 | 98.2 | 1.48 | 98.7 | 1.19 | 1 |
| 7 |   | 0.34 | 96.4 | 0.27 | 81.5 | 0.31 | 97.4 | 0.27 | 79.1 | 0.26 | 3 |
| 8 |   | 0.36 | 85.8 | 0.32 | 57.8 | 0.38 | 86.1 | 0.31 | 64.8 | 0.37 | 5 |
| 9 |   | 0.15 | 64.5 | 0.13 | 49.5 | 0.16 | 65.4 | 0.11 | 49.8 | 0.14 | 7 |
| 10 |   | 0.08 | 44.3 | 0.08 | 35.0 | 0.10 | 45.8 | 0.07 | 36.8 | 0.14 | 10 |
| 11 |   | 0.06 | 30.6 | 0.08 | 27.8 | 0.12 | 20.5 | 0.04 | 33.7 | 0.13 | 12 |
| 12 |   | 0.13 | 21.1 | 0.03 | 36.0 | 0.15 | 22.3 | 0.02 | 38.2 | 0.08 | 14 |
| 13 |   | 0.33 | 17.9 | 0.03 | 56.0 | 0.30 | 13.8 | 0.02 | 74.1 | 0.61 | 17 |
| 14 |   | 0.92 | 13.9 | 0.01 | 76.2 | 0.82 | 7.1 | 0.01 | 87.9 | 1.94 | 19 |
| 15 |   | 2.61 | 11.2 | 0.01 | 97.1 | 1.95 | 8.9 | 0.01 | 98.4 | 2.96 | 24 |

TABLE 7

| A<br>Seq ID | B<br>live | C<br>ex | D<br>int | E<br>ex freq | F<br>int freq |
|---|---|---|---|---|---|
| 782 | 202 | 1028 | 520 | 0.204 | 0.103 |
| 831 | 276 | 768 | 453 | 0.111 | 0.066 |
| 783 | 339 | 1 | 0 | 0.000 | 0.000 |
| 832 | 344 | 884 | 745 | 0.103 | 0.087 |
| 833 | 301 | 880 | 496 | 0.117 | 0.066 |
| 834 | 359 | 976 | 618 | 0.109 | 0.069 |
| 816 | 358 | 39 | 18 | 0.004 | 0.002 |
| 784 | 330 | 0 | 0 | 0 | 0 |
| 785 | 282 | 8 | 3 | 0.001 | 0.000 |
| 835 | 227 | 344 | 163 | 0.061 | 0.029 |
| 836 | 324 | 596 | 304 | 0.074 | 0.038 |
| 837 | 435 | 892 | 367 | 0.082 | 0.034 |
| 838 | 329 | 656 | 268 | 0.080 | 0.033 |
| 839 | 404 | 796 | 425 | 0.079 | 0.042 |
| 840 | 288 | 1048 | 686 | 0.146 | 0.095 |
| 786 | 192 | 1 | 0 | 0.000 | 0.000 |
| 817 | 308 | 127 | 65 | 0.016 | 0.008 |
| 787 | 209 | 1 | 0 | 0.000 | 0.000 |
| 841 | 358 | 1180 | 696 | 0.132 | 0.078 |
| 842 | 289 | 1240 | 532 | 0.172 | 0.074 |
| 843 | 370 | 736 | 480 | 0.080 | 0.052 |
| 844 | 367 | 932 | 628 | 0.102 | 0.068 |

TABLE 7-continued

| A Seq ID | B live | C ex | D int | E ex freq | F int freq |
|---|---|---|---|---|---|
| 845 | 305 | 916 | 540 | 0.120 | 0.071 |
| 846 | 186 | 956 | 456 | 0.206 | 0.098 |
| 847 | 315 | 644 | 384 | 0.082 | 0.049 |
| 848 | 201 | 604 | 281 | 0.120 | 0.056 |
| 849 | 367 | 664 | 254 | 0.072 | 0.028 |
| 788 | 436 | 3 | 0 | 0.000 | 0.000 |
| 818 | 336 | 36 | 20 | 0.004 | 0.002 |
| 789 | 373 | 5 | 0 | 0.001 | 0.000 |
| 850 | 269 | 596 | 302 | 0.089 | 0.045 |
| 790 | 290 | 0 | 0 | 0 | 0 |
| 819 | 300 | 76 | 62 | 0.010 | 0.008 |
| 820 | 265 | 46 | 31 | 0.007 | 0.005 |
| 851 | 373 | 680 | 468 | 0.073 | 0.050 |
| 852 | 257 | 668 | 460 | 0.104 | 0.072 |
| 853 | 194 | 824 | 568 | 0.170 | 0.117 |
| 791 | 275 | 0 | 0 | 0 | 0 |
| 854 | 202 | 568 | 228 | 0.112 | 0.045 |
| 792 | 153 | 0 | 0 | 0 | 0 |
| 793 | 336 | 0 | 1 | 0.000 | 0.000 |
| 821 | 221 | 106 | 59 | 0.019 | 0.011 |
| 855 | 306 | 672 | 273 | 0.088 | 0.036 |
| 856 | 366 | 1112 | 418 | 0.122 | 0.046 |
| 822 | 299 | 37 | 27 | 0.005 | 0.004 |
| 857 | 379 | 856 | 425 | 0.090 | 0.045 |
| 794 | 283 | 7 | 0 | 0.001 | 0.000 |
| 795 | 351 | 7 | 1 | 0.001 | 0.000 |
| 823 | 310 | 47 | 23 | 0.006 | 0.003 |
| 858 | 251 | 744 | 348 | 0.119 | 0.055 |
| 859 | 346 | 852 | 504 | 0.098 | 0.058 |
| 860 | 344 | 540 | 244 | 0.063 | 0.028 |
| 861 | 222 | 756 | 364 | 0.136 | 0.066 |
| 805 | 327 | 64 | 19 | 0.008 | 0.002 |
| 862 | 239 | 724 | 400 | 0.121 | 0.067 |
| 863 | 142 | 596 | 356 | 0.168 | 0.100 |
| 796 | 257 | 0 | 0 | 0 | 0 |
| 806 | 239 | 512 | 184 | 0.086 | 0.031 |
| 807 | 266 | 428 | 169 | 0.064 | 0.025 |
| 864 | 204 | 736 | 362 | 0.144 | 0.071 |
| 865 | 198 | 900 | 312 | 0.182 | 0.063 |
| 866 | 274 | 1024 | 482 | 0.149 | 0.070 |
| 797 | 245 | 8 | 5 | 0.001 | 0.001 |
| 808 | 265 | 108 | 33 | 0.016 | 0.005 |
| 824 | 251 | 86 | 42 | 0.014 | 0.007 |
| 867 | 231 | 572 | 346 | 0.099 | 0.060 |
| 798 | 202 | 0 | 0 | 0 | 0 |
| 825 | 331 | 56 | 25 | 0.007 | 0.003 |
| 799 | 273 | 2 | 0 | 0.000 | 0.000 |
| 809 | 312 | 46 | 15 | 0.006 | 0.002 |
| 826 | 218 | 99 | 87 | 0.018 | 0.016 |
| 800 | 188 | 0 | 0 | 0 | 0 |
| 868 | 238 | 792 | 387 | 0.133 | 0.065 |
| 827 | 209 | 97 | 43 | 0.019 | 0.008 |
| 801 | 209 | 2 | 3 | 0.000 | 0.001 |
| 869 | 262 | 748 | 292 | 0.114 | 0.045 |
| 870 | 225 | 408 | 168 | 0.073 | 0.030 |
| 828 | 205 | 20 | 14 | 0.004 | 0.003 |
| 871 | 260 | 752 | 295 | 0.116 | 0.045 |
| 802 | 178 | 5 | 0 | 0.001 | 0.000 |
| 803 | 173 | 1 | 1 | 0.000 | 0.000 |
| 872 | 269 | 856 | 362 | 0.127 | 0.054 |
| 873 | 214 | 648 | 284 | 0.121 | 0.053 |
| 810 | 197 | 144 | 55 | 0.029 | 0.011 |
| 829 | 264 | 30 | 13 | 0.005 | 0.002 |
| 811 | 257 | 364 | 81 | 0.057 | 0.013 |
| 812 | 207 | 436 | 136 | 0.084 | 0.026 |
| 813 | 192 | 568 | 221 | 0.118 | 0.046 |
| 874 | 216 | 716 | 406 | 0.133 | 0.075 |
| 814 | 113 | 528 | 197 | 0.187 | 0.070 |
| 815 | 150 | 640 | 23 | 0.171 | 0.006 |
| 830 | 216 | 46 | 393 | 0.009 | 0.073 |
| 875 | 150 | 620 | 292 | 0.165 | 0.078 |
| 876 | 241 | 788 | 388 | 0.131 | 0.064 |
| 877 | 162 | 572 | 274 | 0.141 | 0.068 |
| 804 | 145 | 10 | 4 | 0.003 | 0.001 |

TABLE 8

| Variable Name | A Position | B From | C To | D Int Weight | E Int Weight Std | F Int Mean-SD | G Ex Weight | H Ex Weight Std | I Ex Mean-SD |
|---|---|---|---|---|---|---|---|---|---|
| A514R | 514 | A | R | 0.447 | 0.047 | 0.400 | 0.378 | 0.052 | 0.325 |
| V458L | 458 | V | L | 0.422 | 0.056 | 0.366 | 0.265 | 0.063 | 0.203 |
| E22D | 22 | E | D | 0.366 | 0.041 | 0.325 | 0.363 | 0.045 | 0.319 |
| V258L | 258 | V | L | 0.311 | 0.043 | 0.268 | 0.239 | 0.052 | 0.186 |
| V515I | 515 | V | I | 0.289 | 0.074 | 0.215 | 0.360 | 0.074 | 0.286 |
| I210L | 210 | I | L | 0.255 | 0.066 | 0.190 | 0.319 | 0.083 | 0.236 |
| T202R | 202 | T | R | 0.220 | 0.036 | 0.184 | 0.130 | 0.047 | 0.083 |
| V253I | 253 | V | I | 0.204 | 0.076 | 0.128 | 0.241 | 0.078 | 0.162 |
| N214D | 214 | N | D | 0.189 | 0.056 | 0.133 | 0.088 | 0.053 | 0.035 |
| S408E | 408 | S | E | 0.185 | 0.046 | 0.139 | 0.193 | 0.057 | 0.136 |
| Y164F | 164 | Y | F | 0.184 | 0.047 | 0.137 | 0.296 | 0.061 | 0.234 |
| D160E | 160 | D | E | 0.178 | 0.071 | 0.107 | 0.052 | 0.073 | −0.021 |
| L468I | 468 | L | I | 0.173 | 0.069 | 0.104 | 0.135 | 0.063 | 0.072 |
| A124C | 124 | A | C | 0.165 | 0.050 | 0.115 | 0.129 | 0.048 | 0.081 |
| D550R | 550 | D | R | 0.165 | 0.053 | 0.112 | 0.246 | 0.051 | 0.195 |
| L138V | 138 | L | V | 0.164 | 0.057 | 0.107 | 0.060 | 0.084 | −0.024 |
| V386I | 386 | V | I | 0.155 | 0.057 | 0.098 | 0.157 | 0.049 | 0.109 |
| L409I | 409 | L | I | 0.151 | 0.056 | 0.095 | 0.257 | 0.068 | 0.189 |
| V467I | 467 | V | I | 0.145 | 0.069 | 0.077 | 0.183 | 0.075 | 0.108 |
| R548K | 548 | R | K | 0.131 | 0.046 | 0.086 | 0.171 | 0.055 | 0.116 |
| I167L | 167 | I | L | 0.131 | 0.060 | 0.071 | 0.387 | 0.066 | 0.322 |
| Q131D | 131 | Q | D | 0.118 | 0.063 | 0.054 | 0.130 | 0.068 | 0.061 |
| S551R | 551 | S | R | 0.109 | 0.062 | 0.047 | 0.069 | 0.076 | −0.006 |
| A284L | 284 | A | L | 0.104 | 0.050 | 0.053 | 0.214 | 0.050 | 0.164 |
| I206L | 206 | I | L | 0.087 | 0.052 | 0.035 | 0.058 | 0.066 | −0.008 |
| M400L | 400 | M | L | 0.073 | 0.072 | 0.001 | 0.031 | 0.088 | −0.056 |
| D549K | 549 | D | K | 0.069 | 0.058 | 0.011 | 0.135 | 0.074 | 0.061 |
| A171T | 171 | A | T | 0.061 | 0.066 | −0.005 | 0.103 | 0.055 | 0.048 |
| L361I | 361 | L | I | 0.052 | 0.065 | −0.013 | 0.045 | 0.065 | −0.020 |
| I281F | 281 | I | F | 0.032 | 0.054 | −0.022 | 0.056 | 0.055 | 0.001 |
| F455Y | 455 | F | Y | 0.024 | 0.043 | −0.020 | 0.167 | 0.045 | 0.121 |

TABLE 8-continued

| Variable Name | A Position | B From | C To | D Int Weight | E Int Weight Std | F Int Mean-SD | G Ex Weight | H Ex Weight Std | I Ex Mean-SD |
|---|---|---|---|---|---|---|---|---|---|
| S524P | 524 | S | P | 0.022 | 0.065 | −0.043 | −0.075 | 0.065 | −0.140 |
| F149R | 149 | F | R | 0.012 | 0.067 | −0.055 | 0.016 | 0.078 | −0.062 |
| N562K | 562 | N | K | −0.019 | 0.041 | −0.060 | −0.032 | 0.046 | −0.078 |
| A465S | 465 | A | S | −0.028 | 0.061 | −0.090 | −0.019 | 0.060 | −0.079 |
| W469Y | 469 | W | Y | −0.032 | 0.059 | −0.090 | −0.010 | 0.071 | −0.081 |
| D459N | 459 | D | N | −0.061 | 0.054 | −0.115 | −0.412 | 0.054 | −0.466 |
| L200R | 200 | L | R | −0.067 | 0.061 | −0.129 | −0.024 | 0.060 | −0.084 |
| F333W | 333 | F | W | −0.075 | 0.058 | −0.134 | −0.241 | 0.049 | −0.290 |
| M270I | 270 | M | I | −0.076 | 0.041 | −0.117 | −0.126 | 0.048 | −0.174 |
| R175K | 175 | R | K | −0.083 | 0.062 | −0.145 | 0.207 | 0.067 | 0.141 |
| Y337I | 337 | Y | I | −0.091 | 0.071 | −0.162 | −0.056 | 0.077 | −0.133 |
| D82K | 82 | D | K | −0.101 | 0.066 | −0.166 | −0.196 | 0.067 | −0.263 |
| L156T | 156 | L | T | −0.102 | 0.051 | −0.153 | −0.005 | 0.042 | −0.048 |
| V251L | 251 | V | L | −0.112 | 0.066 | −0.178 | −0.074 | 0.083 | −0.157 |
| M319L | 319 | M | L | −0.130 | 0.036 | −0.166 | −0.052 | 0.047 | −0.099 |
| K177N | 177 | K | N | −0.172 | 0.046 | −0.218 | 0.043 | 0.045 | −0.002 |
| W237F | 237 | W | F | −0.186 | 0.066 | −0.252 | −0.201 | 0.075 | −0.276 |
| S461A | 461 | S | A | −0.254 | 0.057 | −0.312 | −0.244 | 0.082 | −0.326 |
| T402S | 402 | T | S | −0.258 | 0.062 | −0.319 | −0.371 | 0.053 | −0.424 |
| G178R | 178 | G | R | −0.299 | 0.038 | −0.337 | −0.364 | 0.043 | −0.407 |
| K435Q | 435 | K | Q | −0.440 | 0.046 | −0.487 | −0.357 | 0.070 | −0.427 |
| H404D | 404 | H | D | −0.466 | 0.034 | −0.500 | −0.591 | 0.044 | −0.634 |
| G172A | 172 | G | A | −0.471 | 0.073 | −0.544 | −0.560 | 0.091 | −0.651 |
| H326R | 326 | H | R | −0.493 | 0.041 | −0.534 | −0.508 | 0.049 | −0.557 |
| G322P | 322 | G | P | −0.517 | 0.053 | −0.570 | −0.727 | 0.061 | −0.788 |
| A512R | 512 | A | R | −0.579 | 0.058 | −0.637 | −0.661 | 0.074 | −0.734 |
| Y440M | 440 | Y | M | −0.641 | 0.056 | −0.698 | −0.691 | 0.062 | −0.754 |
| L323V | 323 | L | V | −0.660 | 0.069 | −0.729 | −0.708 | 0.074 | −0.782 |
| D422F | 422 | D | F | −0.826 | 0.071 | −0.897 | −0.920 | 0.084 | −1.004 |

TABLE 9

| A Seq ID | B live | C ex | D int | E ex freq | F int freq |
|---|---|---|---|---|---|
| 782 | 303 | 118 | 106 | 0.389 | 0.350 |
| 853 | 203 | 75 | 78 | 0.369 | 0.384 |
| 878 | 334 | 115 | 59 | 0.344 | 0.177 |
| 879 | 299 | 86 | 91 | 0.288 | 0.304 |
| 880 | 301 | 84 | 77 | 0.279 | 0.256 |
| 881 | 298 | 56 | 61 | 0.188 | 0.205 |
| 882 | 245 | 55 | 63 | 0.224 | 0.257 |
| 883 | 237 | 66 | 62 | 0.278 | 0.262 |
| 884 | 211 | 58 | 60 | 0.275 | 0.284 |
| 885 | 251 | 104 | 101 | 0.414 | 0.402 |
| 886 | 260 | 51 | 47 | 0.196 | 0.181 |
| 887 | 230 | 60 | 72 | 0.261 | 0.313 |
| 888 | 192 | 94 | 66 | 0.490 | 0.344 |
| 889 | 260 | 58 | 51 | 0.223 | 0.196 |
| 890 | 200 | 75 | 62 | 0.375 | 0.310 |
| 891 | 240 | 62 | 56 | 0.258 | 0.233 |
| 892 | 199 | 18 | 36 | 0.090 | 0.181 |
| 893 | 208 | 70 | 52 | 0.337 | 0.250 |
| 894 | 269 | 68 | 49 | 0.253 | 0.182 |
| 895 | 248 | 97 | 62 | 0.391 | 0.250 |
| 896 | 240 | 83 | 74 | 0.346 | 0.308 |
| 897 | 232 | 62 | 57 | 0.267 | 0.246 |
| 898 | 236 | 42 | 37 | 0.178 | 0.157 |
| 899 | 286 | 53 | 43 | 0.185 | 0.150 |
| 900 | 230 | 71 | 77 | 0.309 | 0.335 |
| 901 | 162 | 30 | 30 | 0.185 | 0.185 |
| 902 | 296 | 120 | 91 | 0.405 | 0.307 |
| 903 | 265 | 115 | 115 | 0.434 | 0.434 |
| 904 | 315 | 86 | 85 | 0.273 | 0.270 |
| 905 | 282 | 108 | 109 | 0.383 | 0.387 |
| 906 | 320 | 78 | 79 | 0.244 | 0.247 |
| 907 | 295 | 80 | 85 | 0.271 | 0.288 |
| 908 | 211 | 58 | 37 | 0.275 | 0.175 |

7. REFERENCES

All references cited herein are incorporated herein by reference in their entirety and for all purposes to the same extent as if each individual publication or patent or patent application was specifically and individually indicated to be incorporated by reference in its entirety for all purposes. To the extent the information associated with a citation may change with time, the version in effect at the effective filing date of this application is meant, the effective filing date being the filing date of the application or priority application in which the citation was first mentioned.

Many modifications and variations of this invention can be made without departing from its spirit and scope, as will be apparent to those skilled in the art. The specific embodiments described herein are offered by way of example only, and the invention is to be limited only by the terms of the appended claims, along with the full scope of equivalents to which such claims are entitled. Unless otherwise apparent from the context, any embodiment, aspect, element, feature or step can be used in combination with any other.

SEQUENCE LISTING (909 sequences)

SEQ ID NO: 1 - DNA, 420 bp, Artificial sequence
  Synthetic
ttaaccctcrtattatgttaagggtcaatttgacccatttcagtttttggtttgaccaaagaactggttatcctttctttttcttcacgaaagttggtgacttttcctcatctagggtcatgaacttgtgtgtaaaatctggatactgtgaagtgtcgtggaatgtctgtgaacagtttgtatacaaagatgatgttgcgggtcattttgacccacacactttgatgtgagcaagtagctgtccagatccgaaataaacatgtctctttgatgcactttattttgattgctaaattatttatattttgactgtctctgaatagaccttcagatcagagacccaggtgtgtgtgggggaggagctttctctcccttgtccttgtcactgttctcgtgtcatctctttgagaaacagcaaaa

SEQ ID NO: 2 - DNA, 266 bp, Artificial sequence
  Synthetic
agatactgaatattgaaaatctcagaaaatgtgacaagttaaattacaaaaaaaaagtgtttgtgaaggaaaaaaatattaaatatagtgttggaataaaaaaatagtattgtttgtctctttcctaaatgttgaaatattctaaaataaagttgatatcagtttaacctgtttttttattgttttgagtggatttacacagtatgggtcaaaatgacccgcaacataatcaaggtaattttttttcaacataataygagggttaa

SEQ ID NO: 3 - DNA, 416 bp, Artificial sequence
  Synthetic
ccctcrtattatgttaagggtcaatttgacccatttcagtttttggtttgaccaaagaactggttatcctttctttttcttcacgaaagttggtgacttttcctcatctagggtcatgaacttgtgtgtaaaatctggatactgtgaagtgtcgtggaatgtctgtgaacagtttgtatacaaagatgatgttgcgggtcattttgacccacacactttgatgtgagcaagtagctgtccagatccgaaataaacatgtctctttgatgcactttattttgattgctaaattatttatattttgactgtctctgaatagaccttcagatcagagacccaggtgtgtgtgggggaggagctttctctcccttgtccttgtcactgttctcgtgtcatctctttgagaaacagcaaaa

SEQ ID NO: 4 - DNA, 262 bp, Artificial sequence
  Synthetic
agatactgaatattgaaaatctcagaaaatgtgacaagttaaattacaaaaaaaaagtgtttgtgaaggaaaaaaatattaaatatagtgttggaataaaaaaatagtattgtttgtctctttcctaaatgttgaaatattctaaaataaagttgatatcagtttaacctgtttttttattgttttgagtggatttacacagtatgggtcaaaatgacccgcaacataatcaaggtaattttttttcaacataataygaggg

SEQ ID NO: 5 - DNA, 401 bp, Artificial sequence
  Synthetic
aagggtcaatttgacccatttcagtttttggtttgaccaaagaactggttatcctttctttttcttcacgaaagttggtgacttttcctcatctagggtcatgaacttgtgtgtaaaatctggatactgtgaagtgtcgtggaatgtctgtgaacagtttgtatacaaagatgatgttgcgggtcattttgacccacacactttgatgtgagcaagtagctgtccagatccgaaataaacatgtctctttgatgcactttattttgattgctaaattatttatattttgactgtctctgaatagaccttcagatcagagacccaggtgtgtgtgggggaggagctttctctcccttgtccttgtcactgttctcgtgtcatctctttgagaaacagcaaaa

SEQ ID NO: 6 - DNA, 247 bp, Artificial sequence
  Synthetic
agatactgaatattgaaaatctcagaaaatgtgacaagttaaattacaaaaaaaaagtgtttgtgaaggaaaaaaatattaaatatagtgttggaataaaaaaatagtattgtttgtctctttcctaaatgttgaaatattctaaaataaagttgatatcagtttaacctgtttttttattgttttgagtggatttacacagtatgggtcaaaatgacccgcaacataatcaaggtaattttttttc

SEQ ID NO: 7 - DNA, 15 bp, Artificial sequence
  Synthetic
ccctcrtattatgtt

SEQ ID NO: 8 - DNA, 15 bp, Artificial sequence
  Synthetic
aacataataygaggg

SEQ ID NO: 9 - DNA, 15 bp, Artificial sequence
  Synthetic
ccctcatattatgtt

SEQ ID NO: 10 - DNA, 15 bp, Artificial sequence
  Synthetic
aacataatacgaggg

SEQ ID NO: 11 - DNA, 265 bp, Artificial sequence
  Synthetic
aagggtcaatttgacccatttcagtttttggtttgaccaaagaactggttatcctttctttttcttcacgaaagttggtgacttttcctcatctagggtcatgaacttgtgtgtaaaatctggatactgtgaagtgtcgtggaatgtctgtgaacagtttgtatacaaagatgatgttgcgggtcattttgacccacacactttgatgtgagcaagtagctgtccagatccgaaataaacatgtctctttgatgcactttatttt

SEQ ID NO: 12 - DNA, 196 bp, Artificial sequence
  Synthetic
aagggtcaatttgacccatttcagtttttggtttgaccaaagaactggttatcctttctttttcttcacgaaagttggtgacttttcctcatctagggtcatgaacttgtgtgtaaaatctggatactgtgaagtgtcgtggaatgtctgtgaacagtttgtatacaaagatgatgttgcgggtcattttgaccca

SEQ ID NO: 13 - DNA, 104 bp, Artificial sequence
  Synthetic
aaaataaagttgatatcagtttaacctgtttttttattgttttgagtggatttacacagtatgggtcaaaatgacccgcaacataatcaaggtaattttttttc

SEQ ID NO: 14 - DNA, 76 bp, Artificial sequence
  Synthetic
tttttttattgttttgagtggatttacacagtatgggtcaaaatgacccgcaacataatcaaggtaattttttttc

SEQ ID NO: 15 - DNA, 44 bp, Artificial sequence
  Synthetic
atgggtcaaaatgacccgcaacataatcaaggtaattttttttc

SEQ ID NO: 16 - DNA, 284 bp, Artificial sequence
  Synthetic
ttaaccctcrtattatgttaagggtcaatttgacccatttcagtttttggtttgaccaaagaactggttatcctttctttttcttcacgaaagttggtgacttttcctcatctagggtcatgaacttgtgtgtaaaatctggatactgtgaagtgtcgtggaatgtctgtgaacagtttgtatacaaagatgatgttgcgggtcattttgacccacacactttgatgtgagcaagtagctgtccagatccgaaataaacatgtctctttgatgcactttatttt

SEQ ID NO: 17 - DNA, 215 bp, Artificial sequence
  Synthetic
ttaaccctcrtattatgttaagggtcaatttgacccatttcagtttttggtttgaccaaagaactggttatcctttctttttcttcacgaaagttggtgacttttcctcatctagggtcatgaacttgtgtgtaaaatctggatactgtgaagtgtcgtggaatgtctgtgaacagtttgtatacaaagatgatgttgcgggtcattttgaccca

SEQ ID NO: 18 - DNA, 123 bp, Artificial sequence
  Synthetic
aaaataaagttgatatcagtttaacctgtttttttattgttttgagtggatttacacagtatgggtcaaaatgacccgcaacataatcaaggtaattttttttcaacataataygagggttaa

SEQ ID NO: 19 - DNA, 95 bp, Artificial sequence
  Synthetic
tttttttattgttttgagtggatttacacagtatgggtcaaaatgacccgcaacataatcaaggtaattttttttcaacataataygagggttaa

SEQ ID NO: 20 - DNA, 63 bp, Artificial sequence
  Synthetic
atgggtcaaaatgacccgcaacataatcaaggtaattttttttcaacataataygagggttaa

SEQ ID NO: 21 - protein, 610 aa, Artificial sequence
  Synthetic
MDISSDTPKPRTSARKRTPAGTFVSHEEKILNWLEEESDDGFSGIDDEDGDPSFEPEIQRDEDDIISREEDSESILEEQQEPVVEVERQQSSDKSQEHYTGKNGFIWSAQEGRRTSRVSAHNIIRLPGRIITKKFEGYLELWSKLIDPTMLESLVRYTNQKLSSYRTKFKNNSMAELVDTNVNEMRAFIGLMYYSSVFKCNDENINTIFATNGTGREIFRCVMSKLRFSCLINCLRFDDSITRQERLKDDTLAPISEIFDKFISNSQSEYTPGAYLCIDEMLVPFRGRCKFIIYMPQKPAKYGIKILLLVDARTYYIYNAYIYHGKYSDGKGLTDQEKKMAVPTQSVLRLAKVVENSNRNITADNWFSSIPLVEILLKRGLTYLGTLKKNKAEIPPCFLPNKNRLAESSLYGFTKDYTLLSYVPKPNKAVLLISSSHHIQEIDKDTGKPIMIADYNSTKGGVDEVDKKCSIYCCSRKTRRWPMAIFQRILDMAGINSFVLYQSCDDSDGKMRRGTFLLNMARDLVLDHMKNRVYNERLPRELRMTLTRVLGKDTPPSPPVARSVPPSGKKLCYICPTKIKRQTKYRCCDCSKPICLQCSKPLCDNCQTKL

SEQ ID NO: 22 - protein, 578 aa, Artificial sequence
  Synthetic
MPRGLKDSEIIQFLEEEEEAIDSASENEQDHDVIVSDHVTESEQSENESNDQWRSEDEVPLQNLASSSQSHDQSFYLGKNRLTKWYKHPPRSMVRTQRSNIVTETAGPKGPARDIMTLSDAFLSIFSRETVDLILTYTNEYIISIQNNFQRERDCKVVSYEELLAFFGLLYMSGVLRSSHLNYQDLWAADGTGIEFFSNTMSCKRFLFILRSLRFDSRTTREVRQSLDKLAAIRDFCNLMNDNFQKCYSMSENVTIDEQLPAFRGRFCGVVYMPSKPTKYGIKHFALVDSATYYLQRFEVYVGVQPDGPFKLPSDTKSLVKRLIEPISGTGRNVTMDNWFTSVPLAKSLLDEHTLTMVGTLRKNKPEIPKCFLPEKKRETTSSIFGFQKDMTLCSYVPKPRKAVMLLSTMHHDDNVEGEKRKPEIIHFYNKTKGGVDTNDQMCATYNVGRRTKRWPMVIFFHIFNITGINSYVIYKSKIDSNISRRLFLKLLAVDLVKPHQMSRASIPTLPRPLQKRLKRQHEIQDQVSIPEAGRSQSYKRCHVCPRSKDRKTKTECFKCHKHVCNDHMNIVCKNCND

SEQ ID NO: 23 - protein, 563 aa, Artificial sequence
  Synthetic
MASILTDEEILSMINNGDFLLSDEDFGLNSGSDSLGEGDSADDDCDQNNIVEQNIANQSPASLTETDLASPQISRENNYNWSTCRPQVIDIPFSETPGLKIFPKGNDPIDYFNLFVTNTFWEFLVEEANSYAVEVFLNSDRSNSRISTWKNTDVVEMKKFIALLFHTGTIRVNRLEDYWKTNELFNFHIFRSTMSRNRFMLLLRVLHFCKNPGQNDNPTSRLHKIDKMTNYFNKTMEELYQPSKNLSIDESMVLFRGRLMFRQYIKNKRHKYGIKLYMMTESWGLVHRVLIYSGEGTGTSEELSHTEYVVEKLMEGYYYKGHSIYMDNYYNSVKLAHYLLEKQTYCTGTLRANRKNNPKAINDKKLKKGETICQYTEKGVGVVKWKDRRDVIAISSEHSHDLVNITNRKGIIKSKPLSIIKYNEYMSGIDRQDQMLSYYPCERKTLRWYKKLGIHFIQILLLNSYLLYNKNVKKISFYDYRLKIISTILNSGENNITKRQPTNNNALHFSKKVPKNKNNKIMYKRCKLCSSKGVRKMTSFYCSMCEDEPGFCLDCFEEFHRSI

SEQ ID NO: 24 - protein, 592 aa, Artificial sequence
  Synthetic
MIMSNRKTVRATDPNFESQVMAWFEESNEELSIDQGDSDEKQWPDENENDVIENHHTSEEEEEEEEEEGEDFDKENEEQPNQNYFYGKNKITRWNKNCPVNSRTRSHNIVKIRVPGPQSSAKNCKTQLETLRCFLDEEIITLIVKYTNIYINEVKDKYSRARDAKLTNNEEVLGLIGILYLAGLLQSGRQHILQMWDNSKGLGVEAIYLTMGINRFRFLMRCLRFDNIIDRNERKKTDNLAAIRKIFEMFVLKFKSMFIPSQYLTLDEQLIAFRGNCPFRTYIPSKPAKYGIKIFALVDCKSIYTCNLEIYCGKQPAGPHSTSWKNYDLVMRMIAHITGTGRNVSMDNWFTSVPLAVDLLQMKTTIIGTLRKNKPDIPPQFINATHREVYSSLFGFHKMCTLVSYVPKRKKVVLLLSTMHHDCAIDNDTGDLKKPEIITDYNNTNYGVDMLDKMCSHYDVSRNSRRWPLTIFFNLLNIAAINGMCIYKTKSINKIDRKSDLQTIGYELITPLLRKRLESDNIATNIKEHIRKLLNIEPEILAEIQPNTSTVGKCFYCGRQKNKSTRKHCSKCGKWVCPAHLRHICPKCNEED

SEQ ID NO: 25 - protein, 565 aa, Artificial sequence
  Synthetic
MAGQYNLRPISALAETLRATEREQASDIPSEEEDHAVEFSGSESEEDADEISEQPDEGNSRKRSNPSIIHGKDGHRWYTTPQQRSQGRQNTPVSYLPGPVGEARRASTPLQMWSLLFPDSLIEKIVRHTNEEIRRYRDSLEIDDDRDRTYSEVGIVEIKAYIGLLYFSGLQKTSHTNLEDLWNPEYGSIMYRSTMSCNRFSVISRNLRFDDKTTRAERRETDKFAPIRELWEQFISNCTKYYNPTSYCTIDEQLVSFRGRCPFKVYNGAKPDKYGIKIVMLNDSRTFYMFSAEPYVGRVTTEKGESVPSYYIRKLSQPLHGTKRNITCDNWFSSIPIFEKMLTEHSITMVGTLRKNKREIPGHFRSAGPVSSSKFAFDGRMTLMAHTPKQNKIVILLSTFHDCATINQETQKMEIIHFYNTTKGGTDSFDQMCHEYSTARKTLRWPMRIWLAMLDQGGINALILYNSNANLEAFNRKTFLKNLIKALVEPHLRARLQLPNFRRELRFNIHTILGQGERPVKRGQQKRARCGLCPRAQDRKVQMYCEMCHRTVCEDHRVIFCCDCA

SEQ ID NO: 26 - protein, 587 aa, Artificial sequence
  Synthetic
MEDAKKRKLTSDDPSVWLKWFEEMSEEENEKDEESCSEIEADILEESPHDTASEQEAGDLESDNDCDDISDSESENFYIGKDKFTKWCKVKPRQNVRTRSCNIIIHLPGPRREAHGVQKEIDILKFFLDDNVFRMIVASTNIKIGVVREKYCRARDAADTDVTEICAFIGLLYLIGSLRCSRKNMHDLWDNSRGNGLESCYLTMSENRFKFLLRCLRFDDIRDRHMRKEVDKLCSIRDLHELLINNFQRYFCASEYLTVDEQLLAFRGNCSFRQYIPSKPAKYGLKIFALVDCKTGYTINLEPYVGKQPEGPYQVGNSGEEIVLRLCNPVEGTNRNITADNWFTSVTVSERLLLEKKLTYVGTMRKNKREIPKEFLPNKSIPAKSSIFGFGKNSTLVSYCLKKGKSVILLSSMHFDDTIDVSTGDHKKPEIVTFYNMTKVGVDLVDQLCQKYDVSRNTRRWPLVMFYNLLNISAINAFVIYKANTRESTQIQRRIFLQNISWELIKPQIERRTAVLTIPKEIRRRARVLLGIEESTVPQKRPGTRGRCLPCGRQRNKTTRRWCCKCQIWACGEHLTDICLQCLENTN

SEQ ID NO: 27 - protein, 564 aa, Artificial sequence
  Synthetic
MTRYMNYDEENEYFRHLIETVSSDDEAISDESVASEDDEYCSNHDSSSEIETETEDESSLSATDFYIGKDKVTKWLKKKYSQSVRKPARNIISKLPGNTAYSKHVASPVDAWNVLFDSKMLNMMVENTNIYIESIQERFTRERDARKTDETEIKAFIGLLYLCGTHKSSHTNLKDLYATDGTGIDIFPKTMSRTRFLFLMRCLRFDNINDRQSRREIDKLAPIRDFFETFVTNCKNAYTLGEFVTIDEKLEPFRGRCGFRQYMPKKPAKYGIKIFALVDSRVFYTWNMEIYAGQQPDGPFKIDCSSKSIVMRLMTPLFNSGRNLTTDNWYTGYELAQELLKKKITIVGTLRQNKREIPPQFLVKKELYSSIFGFQKETTMVSYSAKKNKNVVMLSTMHTDDKIDETTMELKKPDIITFYNLTKGAVDVVDEMAAAYTTARISNRWPMVILFSMLNVAAINARVLLMSTKNPPTQFRNRRFFLKTLGLVLSEQHRKRKPLRKTTKPSTEELEITNSEPPAKKIKETYKRCAFCPCNKDRKSRFICQKCEKSLCVEHQYVICQNCL

SEQ ID NO: 28 - protein, 628 aa, Artificial sequence
  Synthetic
MDLRKQDEKIRQWLEQDIEEDSKGESDNSSSETEDIVEMEVHKNTSSESEVSSESDYEPVCPSKRQRTQIIESEESDNSESIRPSRRQTSRVIDSDETDEDVMSSTPQNIPRNPNVIQPSSRFLYGKNKHKWSSAAKPSSVRTSRRNIIHFIPGPKERAREVSEPIDIFSLFISEDMLQQVVTFTNAEMLIRKNKYKTETFTVSPTNLEEIRALLGLLFNAAAMKSNHLPTRMLFNTHRSGTIFKACMSAERLNFLIKCLRFDDKLTRNVRQRDDRFAPIRDLWQALISNFQKWYTPGSYITVDEQLVGFRGRCSFRMYIPNKPNKYGIKLVMAADVNSKYIVNAIPYLGKGTDPQNQPLATFFIKEITSTLHGTNRNITMDNWFTSVPLANELLMAPYNLTLVGTLRSNKREIPEKLKNSKSRAIGTSMFCYDGDKTLVSYKAKSNKVVFILSTIHDQPDINQETGKPEMIHFYNSTKGAVDTVDQMCSSISTNRKTQRWPLCVFYNMLNLSIINAYVVYVYNNVRNNKKPMSRRDFVIKLGDQLMEPWLRQRLQTVTLRRDIKVMIQDILGESSDLEAPVPSVSNVRKIYYLCPSKARRMTKHRCIKCKQAICGPHNIDICSRCIE

SEQ ID NO: 29 - protein, 599 aa, Artificial sequence
  Synthetic
MASRQHLYQDEIAAILENEDDYSPHDTDSEMEDCVTQDDVRSDVEDEMVDNIGNGTSPASRHEDPETPDPSSEASNLEVTLSSHRIIILPQRSIREKNNHIWSTTKGQSSGRTAAINIVRTNRGPTRMCRNIVDPLLCFQLFIKEEIVEEIVKWTNVEMVQKRVNLKDISASYRDTNEMEIWAIISMLTLSAVMKDNHLSTDELFNVSYGTRYVSVMSRERFEFLLRLLRMGDKLLRPNLRQEDAFTPVRKIWEIFINQCRLNYVPGTNLTVDEQLLGFRGRCPFRMYIPNKPDKYGIKFPMVCDAATKYMVDAIPYLGKSTKTQGLPLGEFYVKELTQTVHGTNRNVTCDNWFTSVPLAKSLLNSPYNLTLVGTIRSNKREIPEEVKNSRSRQVGSSMFCFDGPLTLVSYKPKPSKMVFLLSSCNEDAVVNQSNGKPDMILFYNQTKGGVDSFDQMCSSMSTNRKTNRWPMAVFYGMLNMAFVNSYIIYCHNMLAKKEKPLSRKDFMKKLSTDLTTPSMQKRLEAPTLKRSLRDNITNVLKIVPQAAIDTSFDEPEPKKRRYCGFCSYKKKRMTKTQCFKCKKPVCGEHNIDVCQDCI

SEQ ID NO: 30 - protein, 567 aa, Artificial sequence
  Synthetic
MARSTREAKSCALERILGREMNMPDAQIDLEESDKEEHLSDIEEAELEVALSDASDGSSSSCSRPESPEPAAQAEAVGHRYVSPSGQAWSTNPPARCGQRPAGNILRLRPGITQFATARLHDEESAFKLLFDADMVDTIVVETNREATRVLGQAWLPTTRVEMYGYIGLCFLRGVFKGNMESIEELWSADCGRKIFAETMSLSRFKSLLRFLRFDNRETRAARLQRDKLAAVRLLLDGLVSNSQRSYVPSGAVTVDEQLFPYRGRCRYIQYMPMKPAKYGLKFWCLNDAANAYCWNLQMYVGREEDREVSLGEHVVLRLAEGLRGSGMGITVDNFFCSLSLARRLQRWNLTLLGSMRSHRREVPLQMRSCRNRQLHSTEFVYTEEDKIQLAAYKAKPNKLVLILSSQHSSPAVSAHPAQKPQVILDYNATKGGTDLMDQMTSCYSTKYKSRRWHVPVFCNLLNIAGLNSFLLHQTVFPNRFANAPHRRRLYLVALGRALTQPLRYQVEAGRNPPATVPVHGVQRGRCHMCGRSKDRKTRTRCTHCDRFCCAEHLQEICLACTGDMPE

SEQ ID NO: 31 - protein, 564 aa, Artificial sequence
  Synthetic
MSDSSDDDIVSPGMKRKRVNIFPSSSEENDESIESDSETDQYDSDDIYSEDNKNNKENQYTNVKWKSTSGNRKPFDFIANNGQQEIVPGRFRSKCSSYVEKYLDDHLISIIVKETNLYADQFLQSHPNLKPRSRMRKWYSTTNNEVRCFIAILILQGIVKKPALDMYFLKREIICSPFFGKIFSADRFLLLCKFLYFENNAPHNDMPSKKLCKIKTVLEYVINKCKSLYTPKMDICIDESLLMWKGRLSWRQYIPSKRSRFGIQFFVLCESESGYIWNFFIYTGKETYCDSQYSEFNISARIVLQLCDELFERGYRLYLDNWYTGVPFIEKLCAHKTDVVGTIRKNRIGICEEVRETRIKKGEYIARFKNKIMLLKWRDKREVYLVSTVHNDNIVEMQKRNVIKKVPEVVFDYNNKMGGVDMSDSIIIAYSTARKRLKKYYKKIFLHLLDVICLNSYLIYKMNGGKLSRIHFLLEYIEDTIASYPIESRNLPKSRSTAPNVSRLIEKHFPDYIPGSSRTTNPSRRCAVCYKKKIRKESRYWCPTCQVPLCVVPCFREYHTTETI

SEQ ID NO: 32 - protein, 553 aa, Artificial sequence
  Synthetic
MFSRKRFCDEDSENCAINFANESDSSDEICKFRRKYRRIIVDDTSDDDQLPESWVWNERRNSPKIWDYTMTPGISEAALCQLGGSRGEFDTFNLTFDDIFWNNIVTETNQYANQLRENPHTRRKIDETWFPVDSTEIKRYFALTIIMAQIKKPRIQMNWSKRAVIETPIFRKSMPLKRYLQITRFLHFSNNNLVANTDKLKKVRPVINFLNQKFKELYIMRKDISIDESLMKFRGRLSYKQFNPSKRARFGVKFYKLCESDSGYCYEFKIYTGNDKINCKDSASESVVKELSESVLHRGHTLYIDSWYSSPKLFMILSHKYKTNVIGTVRSNRKNMPKDLCSVKLKRGEYVIRSCNRVLALKWRDKRDVYMMSTKHETAEMTSQGSKRTLKPNCITEYNKGMNGIDLQDQILACFPIMRKYMKGYKKIFFYLFDIGLFNSYILWKKLNDGKKQCYVDYKINIAESLLKKMPKPIYKERGVLSSGDAPDRLCAKEWAHFPKHIDPTPSKLRPSKRCTVCHKNKKRKETTWECKKCKVPLHVPECFERYHTVTDY

SEQ ID NO: 33 - protein, 616 aa, Artificial sequence
  Synthetic
MSEINNAGNSKSKRPSTGSVQGPARKNFRVADPTFEQEVSELLASDQSDNEENIEGLFILENELIQNHESDNDEDQDQESDQVLGEETDSDSSDNIPLAQFVASNYYYGKNRYKWSKTPPLARVRTPQHNIITSRAGSSKLTSEDGKDHYSIWNKLFDEEMLQCILTWTNHRISSYRTKYVRYNRPELNDLDMVELKAFIGLLFYSAVLKSNDENTSYLFASDGTGCEIFRCGMSETRFLVLLLCLRFDNPDDREERMKADKLAAISHIFNKFVSNSQQLYELSECVTVDEMLVKFRGRSYMISYMPKKPGKYGLIIRALCDANNFYFYNGYIYSGKGSDGIGLTAQEKKFLVPTQCVLRLTKPIHGTNRNVTADNWFSSIELVDQLSSRKLTYVGTLKKNKREIPKEFQPKKQREVNSTLFGFTSTKTLCSYVPKKNRAVILVSSMHHSNQVDENTKKPEIIMYYNSTKGGVDEADKKCSIYSSSRRTRRWPMVLLYRVLDLTAMNAYILYNMHQPKAVERGDFLKKLARVLVVPHVQRRVINARLPRELRLTMNRVLGDDMVTEGVQDQETIQGSRRACRICPAKKHRMTTYVCVGCKKPVCLQCSRPLCTDCQ

SEQ ID NO: 34 - protein, 609 aa, Artificial sequence
  Synthetic
MFYSMSVVNLLIFYSILPTMSLSNHPDRILTLLEESDSEDENNDTASDVDNEDHLSERSNNSDSEEDASSIDSDSSENLDLLSLQNRLRQQVFRGKDGTLWQKEPGRSNVRTRSENIITELPGVKLIARDAKTVFECWNLFITQDMLYTIKTCTNSHIQERRALCADVSKQRFMSEVEISELKAFIGLLYLAGFYRSNRQNLKDLWQKDGTGIEIFRLTMSIQRFYFIQSCLRFDDKNTRAERQNLDNLAPIRELFKEFTEQCLSMYSPGENCTIDEMLVAFRGRCKFRQYIPSKPAKYGIKIFALVDSKTFYVKNLEIYAGKQPSGPYSVSNKPFDVVNRLVLPISKTHRNVTFDNWFTSYEVVSHLLNEHRLTTVGTVRKNKKQIPPQFLNIRGKELNSSTFGFQKDISLVSYIPKKNKIVLLMSSLHHDANIDQSTGDQRKPEIITYYNATKSGVDVADELSATYDVSRNSKRWPMTSFYAMLNISGINANIIYRANNTDTRMTRRHFLKKLGLDLIHDHLEVRKTQMNLPRLLRKRILDFVGGPAEEPPRKITGTRKRCQICPAKKDKKTNHTCHVCHIYICPDHIIPYCNNCSTSMAISDDVED

SEQ ID NO: 35 - protein, 615 aa, Artificial sequence
  Synthetic
MTRESISSDEIIRILMNEDEANGDDIFEEECSDDDFVEEDDAANDEVDVESVVDSENESEIIVTESKTSGKRKRVGCNGNAQALKKGKKSDNCWFTQEGTIVTPKKRILIGKNGHTWHSEPPPLGKTPERNIVMRMPGPKRAAKEAISERQCWNLFLNSDMMTIVVKNTNEEIARQRQNYSSAQSFTGDTCTEEMHAYFGILITSAALKDNHLSVEDMWNNFYGKPLYRAAMSKERFRFLTNCMRFDDKNTRDARKASDPFAAIRDITDMFASNCQEMYTPSTCCTIDEQLLAFRGRCPFRIYIPNKPAKYGIKLVMLCDSKTFYAVNIIPYVGKATHNGDIPLADYFVKELSKPIHGTNRNITTDNWFTSVSLGSSLLEDYKLTTVGTLRKNKKEIPPEMTMVSGRKLETSLFIFDDKKTMTSFYPKKNKMVLLLSTMHQGKYVIPETKKPEIIEFYNKTKGGVDTMDQLCNTYSCSRKTRRWPLCVFYGLMNIAGVNAAVIYNTNMAVKGREIIPRKTFLLRLGRELVIPWIEARSVKPTLQSKVRQVISEVLGLENTQKDNSNVNQQVNSGKKAGRCSVCPRKNDRKTTVKCDKCKEFVCNAHKISLCQKCK

SEQ ID NO: 36 - protein, 568 aa, Artificial sequence
  Synthetic
MGDYEKEQQRLLALWEDMESDDEVINNDDSEEEDIDNISVCSDYPDMEQDAEDELEPAEEQTQAKYFFGKDGTKWSKQHPNKKVRTRAENIIIHLPGVKKPAKMAKTPLECFSLFIDEQMIADIVERTNERITEKCAQWKDSPHYGQTSAVEIKAIFGLLYLSGVFRNNHRHLYELWNTDGTGMDIFPATMSQRRCEFLISCLRFDNKSNRAERVNVDKLAHIRAIFDRFVQNCQSAYSPSEYLTIDEKLESFRGKCSFRQFIPNKPARYGIKVHALVDARTYYVLNMEVYVGQQPQGPFRVSNKPKDIIDRLVAPVSKTNRNITFDNWYTSLELLQSLRQKHQLTAVGTIRKNKPYLPPAFLNVKNRDICSTLFGFHEGNTLVSYCPKKGKVVLLLSSLHHDDAVDQTDKKLPEVISFYNFTKCGVDVVDEMSASYNVSRNSRRWPLTLFYSLLNTTGINSQIIYRENNNGIKMARRHFLKKLGIQLVEAHQRSRMSNPRLTRELRGNIRKLLKELLPSEVFEYSEPLSKKRNFQQGRCSECPRAKDRKTRYVCEACDKFICLILYA

SEQ ID NO: 37 - protein, 577 aa, Artificial sequence
  Synthetic
MEPDECRRIQDLLQEVEEEELVSSEDEDSEVDEVQFSDHNSESELSEEEMPVVELHDGPTYKGRDNVTTWRKHQLPRNVRTRQQNIVIHLPGVRPIGQNSNTPKECFSLIFDDTMIETIVASTNIKIAKHSEKNKNDRSTYLTSITEMNALFGLLILSGLVKSGHQNLEDLWNVHQLGIDIFQTTMSLKRFKFLIRYMRFDDINTRHARRQEDKLAPIREIFERFNHNCKQVYTVSEYCTLDEQLVPFRGRCSFRMYIPSKPAKYGLKIFTLVDARTWYILKSEVYVGKQNDGSFKVSNTTVDVTMRLTEPIHRSGRNLTIDNWFTSFPLAELLLQQNVTMVGTMKKNKKELPPELLAKGRPEKSSVFAYQNNKTVVSYVPKKNKNVVLLSTMHLEDGTIDETTGEDSKPEIITFYNMTKGGVDVVDKLCSTYSTARKTNRWPLVLLFRILDLASVNSYVVFQGNNPQSKMNRKSFLQELGFTLVAQQVQTRATQMRLPKEIRQRAAKRAKMDNAIAPAVPPNPGQRSRCTVCPRKNDMKVKTTCFKCNKYMCNKHMKTVCEPCLAPAENTSSDSDY

SEQ ID NO: 38 - protein, 589 aa, Artificial sequence
  Synthetic
MRRLVFRMCSNKDDEVQLETFLNSFTLDDAAIDPQYEDDEDDDEADHLEERTECTDTEEEISDTEEDFGTSPTSDAFYVCKDGVTKWNKKLAPKHERVPENLLKHLPSPRTATKNLISEIDIWSYFFNEGMLKVIVDCTNQHISGTKSHFSRERDAEDTNIHEIKALLGLIYMAGVLKANRLNARELFSTQGCGIEIFRLTMSINRFLFLMRNVRFDNKETREQRKEIDKLAPIRQIFDNFVVNCQSAYSPFHCVTIDEKLEGFRGRCSFKQYIPSKPNKYGIKIFALVDAKCYFTTNLEVYVGKQPDGPYAVDNSASAVVQRLCEPINESGRNVTTDNWFTSIQLLEALKEKKLTLLGTIRKNRKGLPKEFTQPPKSRAVMSTLFGFRDNATLVSYKPKKNKNVLLISSGHHDDGIDENTQKPNMILDYNNTKGGVDTVDKLCASYNCARITRRWPMVVFYALLNIAGINSIVIHKFNNPTVTQPRRTFLRNLSMALIDGHLRQRAQLHCLPRQMSSRIREITGYEEPLQGAAATPSDENIPKRGRCAYCDRRKNRPTKYSCTTCQKFMCLEHCTIVCEECFNKDEIF

SEQ ID NO: 39 - protein, 567 aa, Artificial sequence
  Synthetic
MFSGKRFRDESSVNCANNFANESDSSDDICCVRRKCRRLVIDDTSDDQLPESWLWTKIRNSQKIWEYTMSPGIKEAALCQLGGGRREFDIFNLIFDDIFWNNIVTETSQYADQIRANPHSSREIDETWFPVDSSEIKRYLVLTIIMAQVKKPRIQMNWSKRAVIETLIFRKSMPLKRYLQITRCLHFSNNNLVANTDKLSKIKSVINFLNQKFKEVYIMKEDIAIDESLMKFKGRLSYKQFNPSKRTRFGVKFYKLCESDSGYCYEFKIYTGHDKTNYDDSASESVVKELSESVLHRGHTLYIDNWYSSPRLFMTLSHKYKTNVIGTVRGNRKHMPKDLCNVKLKRGEYTIRSCNRILAIKWKDKRDVYIMSTKHETVEMTAQRYYRTPKPNCILEYNKGMIRIDLQDQILACFPVMRKYMKGYKKIFFYLFGIDLFNSYILWKKINKEKKQCYIDYRINIAESLLKNMPKPNYRERGGLSFGDAPERLHAKHWAHFPKHIDPTASKLRPSKPCRVCQKNKKRSETTWGCKKCKVPLHLPIFTSTRMLRIISHHCRLLILYYCFLYK

SEQ ID NO: 40 - protein, 581 aa, Artificial sequence
  Synthetic
MSLARFLAEEALSQLMNWDSDVEEDISETEDASEPEDYVIDDPGCQFSLDDEDSEDGSAGVPSSNENQEMQKPPSTEGTLTSKDGQIKWSTSPHQTQARLSSSNAIKMTPGPTRFALTRVDGIESAFQLFISPPIEKIILDMTNLEGRRVFQEKWKPLDPSDLHAYIGILVLAGVYRSKGEATASLWSEEYGRPIFRATMSLETFHMISRVIRFDNRATRAGRREKDKLAAIRDVWDKWVKILPLLYNPGPHVTVGERLIPFRGRCPFRQYVPKKPAKYGIKIWAACDAKSSYAWNMQVYTGKPLGGPPEKNQGMRVVLEMTEGLQGHNITCDNFFTSYRLGVELQKRKLTMLGTVRKNKPELPCEILKMQGRPLHSSKFTFTENTTLVSYCPKRNKNVLVMSTMHKDASLSTREDMKPQMILDYNSTKEGVDNLDKVTATYSCQRKSTRWPLVVFYNIVDVSAYNAYVLWTEINQHWNASKLYRRRMFLEELGKALVTPKIQNRARPARSPAAAAVIANVQVRASDQPTMDPLDKCAKKRKRCQVCPSRDDSKTSTSCVRCKKCICRKHTVTFCPSCGEN

SEQ ID NO: 41 - DNA, 3045 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaaccctcatattatgttaagggtcaatttgacccatttcagtttttggtttgaccaaagaactggttatcctttctttttcttcacgaaagttggtgacttttcctcatctagggtcatgaacttgtgtgtaaaatctggatactgtgaagtgtcgtggaatgtctgtgaacagtttgtatacaaagatgatgttgcgggtcattttgacccacacactttgatgtgagcaagtagctgtccagatccgaaataaacatgtctctttgatgcactttattttgattgctaaattatttatattttgactgtctctgaatagaccttcagatcagagacccaggtgtgtgtgggggaggagctttctctcccttgtccttgtcactgttctcgtgtcatctctttgagaaacagcaaaagtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggaagatactgaatattgaaaatctcagaaaatgtgacaagttaaattacaaaaaaaaagtgtttgtgaaggaaaaaaatattaaatatagtgttggaataaaaaaatagtattgtttgtctctttcctaaatgttgaaatattctaaaataaagttgatatcagtttaacctgtttttttattgttttgagtggatttacacagtatgggtcaaaatgacccgcaacataatcaaggtaattttttttcaacataatacgagggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 42 - DNA, 1945 bp, Artificial sequence
  Synthetic
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 43 - DNA, 2507 bp, Artificial sequence
  Synthetic
ttaaccctcatattatgttaagggtcaatttgacccatttcagtttttggtttgaccaaagaactggttatcctttctttttcttcacgaaagttggtgacttttcctcatctagggtcatgaacttgtgtgtaaaatctggatactgtgaagtgtcgtggaatgtctgtgaacagtttgtatacaaagatgatgttgcgggtcattttgacccacacactttgatgtgagcaagtagctgtccagatccgaaataaacatgtctctttgatgcactttattttagagtagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaaagatactgaatattgaaaatctcagaaaatgtgacaagttaaattacaaaaaaaaagtgtttgtgaaggaaaaaaatattaaatatagtgttggaataaaaaaatagtattgtttgtctctttcctaaatgttgaaatattctaaaataaagttgatatcagtttaacctgtttttttattgttttgagtggatttacacagtatgggtcaaaatgacccgcaacataatcaaggtaattttttttcaacataatacgagggttaa

SEQ ID NO: 44 - DNA, 2438 bp, Artificial sequence
  Synthetic
ttaaccctcatattatgttaagggtcaatttgacccatttcagtttttggtttgaccaaagaactggttatcctttctttttcttcacgaaagttggtgacttttcctcatctagggtcatgaacttgtgtgtaaaatctggatactgtgaagtgtcgtggaatgtctgtgaacagtttgtatacaaagatgatgttgcgggtcattttgacccaagagtagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaaagatactgaatattgaaaatctcagaaaatgtgacaagttaaattacaaaaaaaaagtgtttgtgaaggaaaaaaatattaaatatagtgttggaataaaaaaatagtattgtttgtctctttcctaaatgttgaaatattctaaaataaagttgatatcagtttaacctgtttttttattgttttgagtggatttacacagtatgggtcaaaatgacccgcaacataatcaaggtaattttttttcaacataatacgagggttaa

SEQ ID NO: 45 - DNA, 2500 bp, Artificial sequence
  Synthetic
ttaaccctcatattatgttaagggtcaatttgacccatttcagtttttggtttgaccaaagaactggttatcctttctttttcttcacgaaagttggtgacttttcctcatctagggtcatgaacttgtgtgtaaaatctggatactgtgaagtgtcgtggaatgtctgtgaacagtttgtatacaaagatgatgttgcgggtcattttgacccacacactttgatgtgagcaagtagctgtccagatccgaaataaacatgtctctttgatgcactttattttgattgctaaattatttatattttgactgtctctgaatagaccttcagatcagagactcaggtgtgtgtgggggaggagctttctctcccttgtccttgtcactgttctcgtgtcatctctttgagaaacagcaaaaagagtagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaaaaaataaagttgatatcagtttaacctgtttttttattgttttgagtggatttacacagtatgggtcaaaatgacccgcaacataatcaaggtaattttttttcaacataatacgagggttaa

SEQ ID NO: 46 - DNA, 2472 bp, Artificial sequence
  Synthetic
ttaaccctcatattatgttaagggtcaatttgacccatttcagtttttggtttgaccaaagaactggttatcctttctttttcttcacgaaagttggtgacttttcctcatctagggtcatgaacttgtgtgtaaaatctggatactgtgaagtgtcgtggaatgtctgtgaacagtttgtatacaaagatgatgttgcgggtcattttgacccacacactttgatgtgagcaagtagctgtccagatccgaaataaacatgtctctttgatgcactttattttgattgctaaattatttatattttgactgtctctgaatagaccttcagatcagagactcaggtgtgtgtgggggaggagctttctctcccttgtccttgtcactgttctcgtgtcatctctttgagaaacagcaaaaagagtagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatttttttattgttttgagtggatttacacagtatgggtcaaaatgacccgcaacataatcaaggtaattttttttcaacataatacgagggttaa

SEQ ID NO: 47 - DNA, 2440 bp, Artificial sequence
  Synthetic
ttaaccctcatattatgttaagggtcaatttgacccatttcagtttttggtttgaccaaagaactggttatcctttctttttcttcacgaaagttggtgacttttcctcatctagggtcatgaacttgtgtgtaaaatctggatactgtgaagtgtcgtggaatgtctgtgaacagtttgtatacaaagatgatgttgcgggtcattttgacccacacactttgatgtgagcaagtagctgtccagatccgaaataaacatgtctctttgatgcactttattttgattgctaaattatttatattttgactgtctctgaatagaccttcagatcagagactcaggtgtgtgtgggggaggagctttctctcccttgtccttgtcactgttctcgtgtcatctctttgagaaacagcaaaaagagtagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaaatgggtcaaaatgacccgcaacataatcaaggtaattttttttcaacataatacgagggttaa

SEQ ID NO: 48 - DNA, 3319 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaaccgtctgcagctgacgtgtagtcccacagacaccgcgaaatacaaaatcacgtgttataccgtcatttttcaaatatgagcgtcactgctgcgagtaccttactgtatagtgctcgcgcgtcggtcagtgtgcggcggggggtcgcagcgagcgcacgtgtgcgtagcggagggaaggtgtccacgagactaccacgtcagcgttaaggtaagtgtccacgagattaccacttcagtgaaatggttatatcttcatagtgtctcctaaacaaccacgtcagtcattgagtttcaatgatttattattttatgttattttccaattttcataaactatttatactactattttattactacttatactacttacaattaggacagatttctacttttgtttgtaatcaattaacttgaatacaaagccgtttatttaacatacaaacaacataacaatacataataatgttatctctgagtaacacaggttacaggaaacaatatctatacagcacccgcgtgtgcttaagtcgtgctagaaaactaacagtatttaacttgtttttaggtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggattttgaaactctctagtttttaagttgaccaacgaatgtatctcaattttcctagactgattaatgttattgtgaacttttaaaatgtataatgtgaaatttgaaaaatttgattttgttatttttttatgtcataaatgtttaagaagaaatttatagactgatttgtgttaagtaaataaaccttgtttaattttgaaaatagatattgtttttttttttatttcaattaaatataaaatataaaaaggcaagaaatctaacaaacatgaataaattagctgcatattttaattctaaaaaaatatttgctgttgaaatggtgtctggtatactaccacctcagttgaattgtaacaatttaaccacgtcagttgcagagggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 49 - DNA, 2957 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaacccttaattggtcgcgtggggtgtcatacaccccagagcgggttcccaggcgcacaactttttaaaatttgaatttagcgcgctgctcttctaggtagcttcgtaaacacgtaaaacgtacatgattcagttgcgagcggcgctcggttgtggacggttgagctcagagagtgtgtttggggtgcacgacaccccaggtgactgtttgtgtggtctaaattccgagtaagtaaatagttgttaattttattatttccgttttaaaacattgtattttgcaagtgatgaatgttaaaagtgttcaattataataatttgacatttttgaggttatgttgtgatatttttgtttttggttttcagtaaaatcaaaagtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggaaactaggttttgtaaaaaatattttttatattaaaaaaataagttgattatattaaaaatatgtttaaaagttaattaatatgtaagttaaaatgttcgaattaatacaagtgtgattttgcatgtatttagtattttattttatttcctaattctggggtgctaagcaccccacgcgaccgcttatgcaactttgtaggcgcgcccaattaagggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 50 - DNA, 3253 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaacacgttcactgccggtgtcaacacgtagttgacacacgtacattcgccggtggccactgtcaatacgttgttgacaccaaaactatccatttttaatatattgtcacggggtcggcttttatcgcatgttatttatttatttattaatagattcgatagcccgtgtaaaattgaatggtatagttggattcatttttcgaattatttatagaatatttttcctaattattattttcgttgatattatttaatatcttaatatataatacacatataccaaattattattgttgaaatattacacagttttatcttttatgtttgacagtcattcttcaacgtgcgtacattgtcgtagtcagtcgtagtcactagaattgatattattttgtgtgtgtttttttaagtacatttaaaattgttcattttaatcctacatagtgatagtatagtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggaattaaaaattatgtttattgttttatttatatttatacttatttgtaagttaaaaactacagtttaattcaataagtagtatttttttattttatttcattttattaaatattaaaaataaatctatacaaaaaaaaagttgaattttcattttacatttttgtgtaaccgctgtgttgtagtacaaattgaaaaaaaccaaagtacttataaactcaatagtatcgtaatattattgaaaaacataattgtaagtgtgatgtatgataatttatcaagtatttatttagatataattgtggattcttatttattattagcatgaatcgggcgcgcaacgccggtgtcaacacgtagttgacagtatcagccgagactggtttttggttacggctacgcgcgcgctaatgcataattcggtcggcagtgaacgtgttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 51 - DNA, 2849 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaacactccaccgcacgcgcgtctactattgtagactgcagaatttagttacgcaatatttacaacattcatgtaagagaagttgcctgttttcgtgtattcctcaaaaatgacacccttaacgtatttagttggttttcaaacgcggttgctagtgtatcgtcgagtttttttgttatttctacgattgtagagcacgcgtgttctcccgtaactaattctgttaccgcgtaagtatgcaatttaagcgttatttatgggtttttcgttatgttacatttttaggtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggacttgaagatatattttattttactccatactataccttattttcttttgatttctataaataaagttgttataagtatatctaatactttttattatcagaaatggaaaataaataaagattctaataagacgcgaatgttctactattgtagtacatgcgtgttttgttgtatgaaaaaggggcgcgtgcggtggagtgttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 52 - DNA, 3253 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaaccctagaatgcacgactggggtcgatttcgaccccaggcaaactttgaactatatacgctcctgttcgactaactctctaaaagtacgggctacgtcgggcgcagcgttagttgttcgctggcagtgacgcagcaccgtcgcaaagcgtgcgtggggtcgatattgaccccagttgtgagtttccgtttgtgttttgtcacggtaagctaattttatattttttgctagaatcaatatatttcatgtattattacgtaatctgagcataaatagtcataaatattatttaagacaaaatatctcacgacttagtcggtaaaaatcccgttgcctacagataagattgacattttgcagaaagtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggatgcgactaaataagtatttttcattttttttcatattttttactattttgtatcaaattaaattaaaataatacttaaaatacaattttttatggttttttcatcgattttttccatatttcaactttgcgaatttcttcatttttataatcttaaataaatatactttttgaacagaacataacgatgacaatttttttccaattgtctaatgtgtcctcttcaaagtttgaattttgaaaattggttgattacaaaaaaagatacaaatttttgttttaaaaaagaggtttttgctgattttctgcatttttcggtcttcaaatggatttttcactaactaaacttgagtaaaattaaatttatcgtatactattctcttttttattaaaaaacgaagaaatttatgtactattaaggccctttatctctgtaggaccggttttacgatcaaaaaagcgttgagtcgatattgaccccagttatgagttaaaaggtaaaaaaaatgacttgtgcgttctagggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 53 - DNA, 2927 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaaccctacagtggtcgcgcggatgacacttgtcatccaccacttttaatttgctgatagagttggtataggtttaggtggggaactgtggttcccaatagctgcttattatgtatacgcatgtggtatgaacgagtagttttgaattgatttttagtaataaggctcctagtgtgagttaaagttacccggaggacaggtgtcatccacgcgaccattgacgttagtgttggtttcatagacactgtgtatattttccaccatttctcatcgctgaaggtaccaatgcagtttatattttacattagttcaacacagcattttaggatccatattggaggaaattttcagctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggacttgtaaaataactatcatgtatgtaataaaaatattttttgagttctgttggtaattaatactttctctataccatcagtaataaattctgattaccttgtaacacaaaaagatattaaatccgtaaagtggccctaaacaaactgtggatgaccactgtcatccgcgcgattatgcccgtcctaaacattgacgcgaccgctgcagggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 54 - DNA, 2797 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaacccgcgagaactcgcaccgggtataacatgcccgatccattttcattcaaagtttttcttactttcttctattggaacagagccaggatttcgtgtagctgtattcaaggtcacattctttcactaggggaaaagctggttttgttctataaatagattttcaggaacaggtgtcgggggtatgtcatacccgtgctagtcctggcgtcagtcggatcattccttctttttctctcagtttagtgaattgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggaacatgtgagtatgtatttttaaactcaataaaattctttaatgtattattttgtaatgtttaattatgtaaggcttgcttataaacagtattatttcatatttaggtagcagaaatgaactagggtatgagatacccagcgcgagttctcgcgttggaaaacggttgcgtgttctcccgggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 55 - DNA, 2954 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaaccctagataactaaacattcgtccgctcgacgacgcgctatgccgcgaaattgaagtttacctattattccgcgtcccccgcccccgccgctttttctagcttcctgatttgcaaaatagtgcatcgcgtgacacgctcgaggtcacacgacaattaggtcgaaagttacaggaatttcgtcgtccgctcgacgaaagtttagtaattacgtaagtttggcaaaggtaagtgaatgaagtatttttttataattattttttaattctttatagtgataacgtaaggtttatttaaatttattacttttatagttatttagccaattgttataaattccttgttattgctgaaaaatttgcctgttttagtcaaaatttattaacttttcgatcgttttttaggcctagtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggatcatctttcactaagtaattttgttcctatttagtagataagtaacacataattattgtgatattcaaaacttaagaggtttaataaataataataaaaaaaaaatggtttttatttcgtagtctgctcgacgaatgtttagttattacgtaaccgtgaatatagtttagtagtctagggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 56 - DNA, 3065 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaaccctagaagcccaatctacgtcattctgacgtgtatgtcgccgaaaatactctgtctctttctcctgcacgatcggattgccgcgaacgctcgattcaacccagttggcgccgagatctattggaggactgcggcgttgattcggtaagtcccgccattttgtcatagtaacagtattgcacgtcagcttgacgtatatttgggctttgtgttatttttgtaaattttcaacgttagtttattattgcatctttttgttacattactggtttatttgcatgtattactcaaatattatttttattttagcgtagaaaatacagcctagtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggatcatcagactgttttttttgtatttgcattatatattatattctaaagttgatttaattctaagaaaaacattaaaataagtttctttttgtaaaatttaattaattataagaaaaagtttaagttgatctcattttttataaaaatttgcaatgtttccaaagttattattgtaaaagaataaataaaagtaaactgagttttaattgatgttttattatatcattatactatatattacttaaataaaacaataactgaatgtatttctaaaaggaatcactagaaaatatagtgatcaaaaatttacacgtcatttttgcgtatgattgggctttataggttctaaaaatatgattgggcctctagggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 57 - DNA, 3323 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaaccctcaaatggtttttggggtccattggaccccagaggcaaattagaaaccatttgcagggggcatgtgtacaatagcaggccaatatttttggagaattactttttctatggcttttctatgcccatagaaactcaattgtgtgacaggtttaatatcttgaataattggacttattcggttgaatgaattctggggtccaagggaccccagacaagcaagcccataatattgttgtgatatctatggttgatgcccagtcatataaatatgattccacaaagcaactctcacgactattttatgtctgctgcctaccgcaactgacttgtgtgttctaacggcaatcagcttcagttgataagttcaactatcgcgtacaactctggcaactttgtcaatccgccactgaaagcgctgccgacactggtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggacttgctgtacgagcatcatttctgctatttcaaagttattacaattcagaacttgctacaaaattgcctttaacacttgagcaagatgagctgatagcataactggctataatacaacatatacataccatatatacatattacatacttataataagtaatctcaaaaatttaatctcaaatctcaaaatctaaattttccataacttatcataagcacagagctatgtgcaagttctgattgtacactttttgcagcttcttttaattgctcagcatcatgaatttgtacttacatgtaaatatgactatcgcctaattttcatgtaactgtcatctgtgtgcaaacacctgttctgtgctttgcaaacacctgtacttaataaagtcaaataataattaatattaaaattaatagtcaaataaactacacaaataatctgttgtgctcagcatcagattctgaatggggtccattggaccccagaaaaaagaaacagactattttttctttaactgtttgagggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 58 - DNA, 3436 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaaccagttaaccgtgtttgacgactatatccgtcatggagatttggcagaattttgtgccatgacgactttatccgtcatgtgtaaaattttgttacaattcgatatttaaattgtagttctggagaaaattaaattttattcctaaattttaatatgtttaaaatgttcagaggtcacaacgaaatgaaacaagcaaataaaaattataaataatttaagttgattcataacggtctgagagctaactcgtgaacagtgcagttatatctggatatttgattatcccgattttcatcttgatgtaccaaaaccaaaaaaaagtttattagattcttaatttagattctgtattcttttttatactagattctctatttgcggtgatacctggaaacagctcatgtgcgctatctcactccttgtttgttttggatcaggcaatttttgttgctattcagcgcagttctaggacttatcggggatggagatgaaacggttgatttttatcagttgtccgagaattcgtaaacgggggccacccggatatattgttagcctcacatcttgtgcaaactttagcgcaggccgcgattagatatccccacttaggtttattcactcttccgcggtttactagactctaacccacgtttgtcatttcaatttttgaacgtgaacgatgcagtgcatttcagtgtgtctgaaatagtcagtgaatcgtgccaagtcatataaagtgcaatgtaagtgtttcaagtgtctaattattatagttatccagaaaactttcgtaacccactatttttttattcttagcttattttatccccaaagtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggaaattttgttcaactttttaaagttttccattcattatgtataaatatatgttcacattaagcgactgtacaagtattacgaataaaattgttcattttctaaaatcaagtcgtcattttgacccaatatttcaacagtgccacttactctgtgtttgacgactatacccgtcatcgcttgattatcgcgacacacactggtgcgcgctttgcccacaggtcgccacggttaactggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 59 - DNA, 2811 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaaccccttaacctacgatttagattcgaagatgttaggccgaaattgtatacaagttcgcgcagcgttcgggacgttcgcacgacttgggtacacgccgatccgggcaattgtaaacatgacggacatcgcccgtggtagagcggtcgcggtttgtagatagcacagacaagactcgtgatgtatttctatcatctcttcgtatcgtaattagtttccagtcgttcttgatcgcattcgcacgtcgaaatttacgttcataaattctagagaagcaaacccacaaggtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggattttgtattttggagttttgtataaataaatattttgtaatacttgcgcctaccacaattattgcatcagactgtaaatgcgtatcaaatattccacgtaatatttacatcgggcccgatcaccgtacgcgggctatgcccgtcattgtaggttaaggggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 60 - DNA, 3039 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaacctttaagtatggacgtggagtctcacaggctactcaatgtttacgttttcatagtttcacctatttccccccgctccccgcgattgagcagctcagtagcttttgttttagttgccaaactaccaacgagggaggaggttgtgtcgtccggtgaatctcacgtgagttataaccatcgaaaaattgactggagcctgttaggctacacgtccattgttgtcatataatatattttataagggcgattatgtttgtttcagattttgtagtacaaagtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggaatttgcgttattagactgttgtcaaaattttttgtattagttacctgaagtaggttttttgtgtttttggttccttatctattatattttaagaaaaaaagacaaattttgttatagtaataagttgagctgttttaaatatctaaaaatgtagcctaagtaaattaagacttaaaagtgccataattattgatttttcacatttctatatttttgttaataaaagatgattatataagcatgttattttattgctaaataccttaactgtaatatccaatcagtttttaagcaaccttatatcaaattctcaaaaaaaaagtgttagcatataggagcctgtgagactccacgtccgcagtagtgttaagaaaaaattacgtccatacttaaaggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 61 - DNA, 2979 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaacccggcgtgattgacgctgggtcacagtgacccagcgcgttttaaaacggccatattttttttatgagttgatcatttgttttaaccgtttaagtagctggagttacgtcccccctctccttagtcggccggtaagtttagtgctacgtcggctgcgcagcgagatacacgtgcgccaagtcaacgcgggtaagtttgacccagcgtcatcgcgggcgtcgtatttttgtggcattccttttttaattaattttgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggatttcttactatttttaatataaaagtatttttgatctcttatctataacctaagattgttagttcctattattcgtaagaaaagtctattaaaattgttaaaagtagaacaaactaatgaatgttaaattttgaaccttgattttgcatgtgttactttggaaaccaataaaagtatgattgatttaatataatggcataattttattttataacaagcgcagacgaccctttttaacaaataactaaaaaaaataagataacgtcttttatttcgcaaaaaatttactttataatgaggggtaattgtgacccagtgtcattgaccacgtaatttttttcacgtcaatcacgccgggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 62 - DNA, 2920 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaaccctggaatactataccggggtactggattccccgggccatttagtttttctgattttcaggagatggcagcacttatctgattgtgcttccaggtattctcctaactcttaagcatctattcagttgcaggtttgaacttgttctaagtggttgtgttttgtggtatcgctgtcttggggcagtcaattccccagtgtagtgttcatgtaagtataacaaattatagcttttctatcttctataattgagaactgattattgatatttattataagttgtataatgcttttttataattaattattaattaataatgtaaagttgattaattaatcataataattgcattatttcttaattacagctctccaaagtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggaaggttattgtagtggaacagaatcctgttaatgtagtagtaagtattgtatttacatattatcattaaagaaagtgtgagtttttacgatattatttttaattattattttccttgtggggcatctagttccccagtgtagtactagtgtcgccagcaacaactgtagtattccagggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 63 - DNA, 3091 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaacccggcatccgacacatggggtatatgaaaccccaacgcatgaaaaacgttcagtacggattaatacttcgggtctatcgggtgctgcgtcctagtagctttaagtgatacattaatccatacatatcgcttctcagtacacttgaccggttggcgtaatatcgagtaggcgtgtttcaaagtcgtctggatttatcacaccccacctgtcgaatctttaaacttttaaacggtttcattgtgttttataataaatattttataattttgctgcttagataaggtaagtgattttacttttagttatggtgatttggattttgtctagttgcacactgttttatctctattttagtaattaatataataatatagtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggatatgtggtaacatattgtaaaaattgtagtgacttgagttccacagcatatgaataaaatggtattattatttaatattattattaattaatttactttacttatgctggttgcgcgaaatttatctttcatttttcatacaaacccaatgtaggacaataaacatttttttttactataaattaaattaatcgttatttgacatcatatcaacaacaagtcccaccagaaatctaagaaataagtcccagaaataacaaataaattcaaataaaccgttgtttgagttggggtatatagcaccccacctgtcacaaattgtcacaaaaattcacatgtcggatgccgggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 64 - DNA, 3168 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaacctttaaaaggtaacgtgggggtggaaatacccccacttctaaaaaaagaggtatattttttgtcaggagttggcagcagtcgtgtagttccaggtaccttcctgtgaccttgaagacagtctgtattcagtagagtctcagtgctgacacatcctgtttattcaacataacctccaaaagtgcttggggagtctctgtacccccacgttacccgttgtgtcagcacatttcaccgcatccattcttctatttcttttataaaagtaagtatattatagttttttctgacttgaataactagaattgtagttgttataacctaacctataaactcacattaaatttggccttcgtaaacataaactaacctggatgtgtgttacatagcaatttcatcatgtacgacttgcctttacagttattgtattattttgtcacattctaaactcgtttgtgctttgcagagtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggactttgggttgtataaaatgtccactcgttgtagtttttttttgtattaacattaattaataaataatattataacacttttagatattattgtaagtttttttttcctataaaatactgtacattttagatatttgtgaaaaaaactcatacacaaaactaaaaaaaaaagaaaaatgatttttttatgattcttgaagtttttcctaacaaaataaacatctaaattaaatcaaaggtccataatgtcttaagtaaatagaaaaaataaatgggggtaatcagacaccccacgttaccatttatattctactttcccatgttacccattaaaggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 65 - DNA, 2918 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaacctttcagtacacgcgcgcggaccgtcactccgcaaaattcaaacggtttaatttgcccgtggcgccatctgttgttgagttgacaagtctcttttccacgtcatccgtagaccgcgtgtgcatttcactgtttactgtttgacagagagtacgaagtaaatagttgttgttaatagtaaatagttgttcttgttttatattattattaagtagattttagttagtgttagttagtaatagtgttttgtgtttagtaaagacttaatagtagtgtaagtaaataggttattgtggagtattgtttggttaaaacaggtaaataaaagtacgatttcattaaattgttgtcttgagtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggaatatattttgataatttttttaaatgtataaatttattcaattaatttcatactcatataaaaaccaaaaaaaaaaattaaattttataatttttctagcgccatctttcgcctggtggcaaaaatatattttaatgcggactctcagtccggcgcgtgtaatcttgtgtgtattaaaaaccgcgtgtactggaaggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 66 - DNA, 2866 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaaccccttaacctacgattcacgttcgagtgtttcgggcccgaaacgtaaacaaattcgcgcaaccttcgagccattcgcgcgacttgtgtagtacgctgatcgagcctattatctcttcgtatcgtgatcagtttcaagttattcttggtcactttcgcacatcgaaatttactctcataaattctagagaagcagtcccacaaggtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggaactttttgtagtacttgcatctaccacaattattgcatcaagctgtaattacatatcaaatattccaaaaatgtttataattttaagagggcgccgccgctaatatttatatttgacccgatcatcgtactacgggctatgcccgtaatattcacttctggcccgatcatcgtacacgggctatgcccgtaatatttacgtttggcccgatcagcgtacacgggctatgcccgtaatatttatttttggcccgatcaacgtacacgggctctgctcgtagttgtaggttaaggggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 67 - DNA, 3047 bp, Artificial sequence
  Synthetic
ttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagagacattactaaacgaaaggcagtttttctttacacacacacacacacacacacaaaaaacaacaactttgatgcagacttttgcctggttcaggaatcgcgttcgagtaatgaagattacaacttctggaaatcgcaatggggcgaggactcatggatgtcccatggaaacagccattcagctggaactctaactcttatattatgtttatggtcaatttgaccggatttcaatttttgtgttgatcaaagcgcctggttatcctttaaatttaaaaatgtccttttggtttactttattttgataacttctgaagagtcattcagcaccaggtgtgtgtgaaagaggaactttctctccactgtcctgtacactatttccatgccctttctttgagaaatagaccaaaagtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggaaaatgtcaaacattgaaaaaccccaaaaaacaggcaagttaaatagttaaagaaaaagtgttaataattaaaatcagaagttgcttaatatagtattgaaattagtttgtttattcttctcatgtctcctaaatgtttgcataatctaagataaagttattattgggttaaattaatttcctgtctgttttgtgttgatttacacaatgcaggtcaaaattacccgcaacataacaaatgtattttttttctcaacataatacaaggattaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 68 - DNA, 572 bp, Artificial sequence
  Synthetic
ttaaccgtctgcagctgacgtgtagtcccacagacaccgcgaaatacaaaatcacgtgttataccgtcatttttcaaatatgagcgtcactgctgcgagtaccttactgtatagtgctcgcgcgtcggtcagtgtgcggcggggggtcgcagcgagcgcacgtgtgcgtagcggagggaaggtgtccacgagactaccacgtcagcgttaaggtaagtgtccacgagattaccacttcagtgaaatggttatatcttcatagtgtctcctaaacaaccacgtcagtcattgagtttcaatgatttattattttatgttattttccaattttcataaactatttatactactattttattactacttatactacttacaattaggacagatttctacttttgtttgtaatcaattaacttgaatacaaagccgtttatttaacatacaaacaacataacaatacataataatgttatctctgagtaacacaggttacaggaaacaatatctatacagcacccgcgtgtgcttaagtcgtgctagaaaactaacagtatttaacttgtttttag

SEQ ID NO: 69 - DNA, 388 bp, Artificial sequence
  Synthetic
ttttgaaactctctagtttttaagttgaccaacgaatgtatctcaattttcctagactgattaatgttattgtgaacttttaaaatgtataatgtgaaatttgaaaaatttgattttgttatttttttatgtcataaatgtttaagaagaaatttatagactgatttgtgttaagtaaataaaccttgtttaattttgaaaatagatattgtttttttttttatttcaattaaatataaaatataaaaaggcaagaaatctaacaaacatgaataaattagctgcatattttaattctaaaaaaatatttgctgttgaaatggtgtctggtatactaccacctcagttgaattgtaacaatttaaccacgtcagttgcagagggttaa

SEQ ID NO: 70 - DNA, 378 bp, Artificial sequence
  Synthetic
ttaacccttaattggtcgcgtggggtgtcatacaccccagagcgggttcccaggcgcacaactttttaaaatttgaatttagcgcgctgctcttctaggtagcttcgtaaacacgtaaaacgtacatgattcagttgcgagcggcgctcggttgtggacggttgagctcagagagtgtgtttggggtgcacgacaccccaggtgactgtttgtgtggtctaaattccgagtaagtaaatagttgttaattttattatttccgttttaaaacattgtattttgcaagtgatgaatgttaaaagtgttcaattataataatttgacatttttgaggttatgttgtgatatttttgtttttggttttcagtaaaatcaaaa

SEQ ID NO: 71 - DNA, 220 bp, Artificial sequence
  Synthetic
aactaggttttgtaaaaaatattttttatattaaaaaaataagttgattatattaaaaatatgtttaaaagttaattaatatgtaagttaaaatgttcgaattaatacaagtgtgattttgcatgtatttagtattttattttatttcctaattctggggtgctaagcaccccacgcgaccgcttatgcaactttgtaggcgcgcccaattaagggttaa

SEQ ID NO: 72 - DNA, 455 bp, Artificial sequence
  Synthetic
ttaacacgttcactgccggtgtcaacacgtagttgacacacgtacattcgccggtggccactgtcaatacgttgttgacaccaaaactatccatttttaatatattgtcacggggtcggcttttatcgcatgttatttatttatttattaatagattcgatagcccgtgtaaaattgaatggtatagttggattcatttttcgaattatttatagaatatttttcctaattattattttcgttgatattatttaatatcttaatatataatacacatataccaaattattattgttgaaatattacacagttttatcttttatgtttgacagtcattcttcaacgtgcgtacattgtcgtagtcagtcgtagtcactagaattgatattattttgtgtgtgtttttttaagtacatttaaaattgttcattttaatcctacatagtgatagtata

SEQ ID NO: 73 - DNA, 439 bp, Artificial sequence
  Synthetic
attaaaaattatgtttattgttttatttatatttatacttatttgtaagttaaaaactacagtttaattcaataagtagtatttttttattttatttcattttattaaatattaaaaataaatctatacaaaaaaaaagttgaattttcattttacatttttgtgtaaccgctgtgttgtagtacaaattgaaaaaaaccaaagtacttataaactcaatagtatcgtaatattattgaaaaacataattgtaagtgtgatgtatgataatttatcaagtatttatttagatataattgtggattcttatttattattagcatgaatcgggcgcgcaacgccggtgtcaacacgtagttgacagtatcagccgagactggtttttggttacggctacgcgcgcgctaatgcataattcggtcggcagtgaacgtgttaa

SEQ ID NO: 74 - DNA, 286 bp, Artificial sequence
  Synthetic
ttaacactccaccgcacgcgcgtctactattgtagactgcagaatttagttacgcaatatttacaacattcatgtaagagaagttgcctgttttcgtgtattcctcaaaaatgacacccttaacgtatttagttggttttcaaacgcggttgctagtgtatcgtcgagtttttttgttatttctacgattgtagagcacgcgtgttctcccgtaactaattctgttaccgcgtaagtatgcaatttaagcgttatttatgggtttttcgttatgttacatttttag

SEQ ID NO: 75 - DNA, 204 bp, Artificial sequence
  Synthetic
cttgaagatatattttattttactccatactataccttattttcttttgatttctataaataaagttgttataagtatatctaatactttttattatcagaaatggaaaataaataaagattctaataagacgcgaatgttctactattgtagtacatgcgtgttttgttgtatgaaaaaggggcgcgtgcggtggagtgttaa

SEQ ID NO: 76 - DNA, 365 bp, Artificial sequence
  Synthetic
ttaaccctagaatgcacgactggggtcgatttcgaccccaggcaaactttgaactatatacgctcctgttcgactaactctctaaaagtacgggctacgtcgggcgcagcgttagttgttcgctggcagtgacgcagcaccgtcgcaaagcgtgcgtggggtcgatattgaccccagttgtgagtttccgtttgtgttttgtcacggtaagctaattttatattttttgctagaatcaatatatttcatgtattattacgtaatctgagcataaatagtcataaatattatttaagacaaaatatctcacgacttagtcggtaaaaatcccgttgcctacagataagattgacattttgcagaaa

SEQ ID NO: 77 - DNA, 529 bp, Artificial sequence
  Synthetic
tgcgactaaataagtatttttcattttttttcatattttttactattttgtatcaaattaaattaaaataatacttaaaatacaattttttatggttttttcatcgattttttccatatttcaactttgcgaatttcttcatttttataatcttaaataaatatactttttgaacagaacataacgatgacaatttttttccaattgtctaatgtgtcctcttcaaagtttgaattttgaaaattggttgattacaaaaaaagatacaaatttttgttttaaaaaagaggtttttgctgattttctgcatttttcggtcttcaaatggatttttcactaactaaacttgagtaaaattaaatttatcgtatactattctcttttttattaaaaaacgaagaaatttatgtactattaaggccctttatctctgtaggaccggttttacgatcaaaaaagcgttgagtcgatattgaccccagttatgagttaaaaggtaaaaaaaatgacttgtgcgttctagggttaa

SEQ ID NO: 78 - DNA, 354 bp, Artificial sequence
  Synthetic
ttaaccctacagtggtcgcgcggatgacacttgtcatccaccacttttaatttgctgatagagttggtataggtttaggtggggaactgtggttcccaatagctgcttattatgtatacgcatgtggtatgaacgagtagttttgaattgatttttagtaataaggctcctagtgtgagttaaagttacccggaggacaggtgtcatccacgcgaccattgacgttagtgttggtttcatagacactgtgtatattttccaccatttctcatcgctgaaggtaccaatgcagtttatattttacattagttcaacacagcattttaggatccatattggaggaaattttcagct

SEQ ID NO: 79 - DNA, 214 bp, Artificial sequence
  Synthetic
cttgtaaaataactatcatgtatgtaataaaaatattttttgagttctgttggtaattaatactttctctataccatcagtaataaattctgattaccttgtaacacaaaaagatattaaatccgtaaagtggccctaaacaaactgtggatgaccactgtcatccgcgcgattatgcccgtcctaaacattgacgcgaccgctgcagggttaa

SEQ ID NO: 80 - DNA, 253 bp, Artificial sequence
  Synthetic
ttaacccgcgagaactcgcaccgggtataacatgcccgatccattttcattcaaagtttttcttactttcttctattggaacagagccaggatttcgtgtagctgtattcaaggtcacattctttcactaggggaaaagctggttttgttctataaatagattttcaggaacaggtgtcgggggtatgtcatacccgtgctagtcctggcgtcagtcggatcattccttctttttctctcagtttagtgaatt

SEQ ID NO: 81 - DNA, 185 bp, Artificial sequence
  Synthetic
acatgtgagtatgtatttttaaactcaataaaattctttaatgtattattttgtaatgtttaattatgtaaggcttgcttataaacagtattatttcatatttaggtagcagaaatgaactagggtatgagatacccagcgcgagttctcgcgttggaaaacggttgcgtgttctcccgggttaa

SEQ ID NO: 82 - DNA, 411 bp, Artificial sequence
  Synthetic
ttaaccctagataactaaacattcgtccgctcgacgacgcgctatgccgcgaaattgaagtttacctattattccgcgtcccccgcccccgccgctttttctagcttcctgatttgcaaaatagtgcatcgcgtgacacgctcgaggtcacacgacaattaggtcgaaagttacaggaatttcgtcgtccgctcgacgaaagtttagtaattacgtaagtttggcaaaggtaagtgaatgaagtatttttttataattattttttaattctttatagtgataacgtaaggtttatttaaatttattacttttatagttatttagccaattgttataaattccttgttattgctgaaaaatttgcctgttttagtcaaaatttattaacttttcgatcgttttttaggccta

SEQ ID NO: 83 - DNA, 184 bp, Artificial sequence
  Synthetic
tcatctttcactaagtaattttgttcctatttagtagataagtaacacataattattgtgatattcaaaacttaagaggtttaataaataataataaaaaaaaaatggtttttatttcgtagtctgctcgacgaatgtttagttattacgtaaccgtgaatatagtttagtagtctagggttaa

SEQ ID NO: 84 - DNA, 331 bp, Artificial sequence
  Synthetic
ttaaccctagaagcccaatctacgtcattctgacgtgtatgtcgccgaaaatactctgtctctttctcctgcacgatcggattgccgcgaacgctcgattcaacccagttggcgccgagatctattggaggactgcggcgttgattcggtaagtcccgccattttgtcatagtaacagtattgcacgtcagcttgacgtatatttgggctttgtgttatttttgtaaattttcaacgttagtttattattgcatctttttgttacattactggtttatttgcatgtattactcaaatattatttttattttagcgtagaaaatacagccta

SEQ ID NO: 85 - DNA, 375 bp, Artificial sequence
  Synthetic
tcatcagactgttttttttgtatttgcattatatattatattctaaagttgatttaattctaagaaaaacattaaaataagtttctttttgtaaaatttaattaattataagaaaaagtttaagttgatctcattttttataaaaatttgcaatgtttccaaagttattattgtaaaagaataaataaaagtaaactgagttttaattgatgttttattatatcattatactatatattacttaaataaaacaataactgaatgtatttctaaaaggaatcactagaaaatatagtgatcaaaaatttacacgtcatttttgcgtatgattgggctttataggttctaaaaatatgattgggcctctagggttaa

SEQ ID NO: 86 - DNA, 433 bp, Artificial sequence
  Synthetic
ttaaccctcaaatggtttttggggtccattggaccccagaggcaaattagaaaccatttgcagggggcatgtgtacaatagcaggccaatatttttggagaattactttttctatggcttttctatgcccatagaaactcaattgtgtgacaggtttaatatcttgaataattggacttattcggttgaatgaattctggggtccaagggaccccagacaagcaagcccataatattgttgtgatatctatggttgatgcccagtcatataaatatgattccacaaagcaactctcacgactattttatgtctgctgcctaccgcaactgacttgtgtgttctaacggcaatcagcttcagttgataagttcaactatcgcgtacaactctggcaactttgtcaatccgccactgaaagcgctgccgacactg

SEQ ID NO: 87 - DNA, 531 bp, Artificial sequence
  Synthetic
cttgctgtacgagcatcatttctgctatttcaaagttattacaattcagaacttgctacaaaattgcctttaacacttgagcaagatgagctgatagcataactggctataatacaacatatacataccatatatacatattacatacttataataagtaatctcaaaaatttaatctcaaatctcaaaatctaaattttccataacttatcataagcacagagctatgtgcaagttctgattgtacactttttgcagcttcttttaattgctcagcatcatgaatttgtacttacatgtaaatatgactatcgcctaattttcatgtaactgtcatctgtgtgcaaacacctgttctgtgctttgcaaacacctgtacttaataaagtcaaataataattaatattaaaattaatagtcaaataaactacacaaataatctgttgtgctcagcatcagattctgaatggggtccattggaccccagaaaaaagaaacagactattttttctttaactgtttgagggttaa

SEQ ID NO: 88 - DNA, 837 bp, Artificial sequence
  Synthetic
ttaaccagttaaccgtgtttgacgactatatccgtcatggagatttggcagaattttgtgccatgacgactttatccgtcatgtgtaaaattttgttacaattcgatatttaaattgtagttctggagaaaattaaattttattcctaaattttaatatgtttaaaatgttcagaggtcacaacgaaatgaaacaagcaaataaaaattataaataatttaagttgattcataacggtctgagagctaactcgtgaacagtgcagttatatctggatatttgattatcccgattttcatcttgatgtaccaaaaccaaaaaaaagtttattagattcttaatttagattctgtattcttttttatactagattctctatttgcggtgatacctggaaacagctcatgtgcgctatctcactccttgtttgttttggatcaggcaatttttgttgctattcagcgcagttctaggacttatcggggatggagatgaaacggttgatttttatcagttgtccgagaattcgtaaacgggggccacccggatatattgttagcctcacatcttgtgcaaactttagcgcaggccgcgattagatatccccacttaggtttattcactcttccgcggtttactagactctaacccacgtttgtcatttcaatttttgaacgtgaacgatgcagtgcatttcagtgtgtctgaaatagtcagtgaatcgtgccaagtcatataaagtgcaatgtaagtgtttcaagtgtctaattattatagttatccagaaaactttcgtaacccactatttttttattcttagcttattttatccccaaa

SEQ ID NO: 89 - DNA, 240 bp, Artificial sequence
  Synthetic
aattttgttcaactttttaaagttttccattcattatgtataaatatatgttcacattaagcgactgtacaagtattacgaataaaattgttcattttctaaaatcaagtcgtcattttgacccaatatttcaacagtgccacttactctgtgtttgacgactatacccgtcatcgcttgattatcgcgacacacactggtgcgcgctttgcccacaggtcgccacggttaactggttaa

SEQ ID NO: 90 - DNA, 288 bp, Artificial sequence
  Synthetic
ttaaccccttaacctacgatttagattcgaagatgttaggccgaaattgtatacaagttcgcgcagcgttcgggacgttcgcacgacttgggtacacgccgatccgggcaattgtaaacatgacggacatcgcccgtggtagagcggtcgcggtttgtagatagcacagacaagactcgtgatgtatttctatcatctcttcgtatcgtaattagtttccagtcgttcttgatcgcattcgcacgtcgaaatttacgttcataaattctagagaagcaaacccacaag

SEQ ID NO: 91 - DNA, 164 bp, Artificial sequence
  Synthetic
ttttgtattttggagttttgtataaataaatattttgtaatacttgcgcctaccacaattattgcatcagactgtaaatgcgtatcaaatattccacgtaatatttacatcgggcccgatcaccgtacgcgggctatgcccgtcattgtaggttaaggggttaa

SEQ ID NO: 92 - DNA, 280 bp, Artificial sequence
  Synthetic
ttaacctttaagtatggacgtggagtctcacaggctactcaatgtttacgttttcatagtttcacctatttccccccgctccccgcgattgagcagctcagtagcttttgttttagttgccaaactaccaacgagggaggaggttgtgtcgtccggtgaatctcacgtgagttataaccatcgaaaaattgactggagcctgttaggctacacgtccattgttgtcatataatatattttataagggcgattatgtttgtttcagattttgtagtacaaa

SEQ ID NO: 93 - DNA, 400 bp, Artificial sequence
  Synthetic
atttgcgttattagactgttgtcaaaattttttgtattagttacctgaagtaggttttttgtgtttttggttccttatctattatattttaagaaaaaaagacaaattttgttatagtaataagttgagctgttttaaatatctaaaaatgtagcctaagtaaattaagacttaaaagtgccataattattgatttttcacatttctatatttttgttaataaaagatgattatataagcatgttattttattgctaaataccttaactgtaatatccaatcagtttttaagcaaccttatatcaaattctcaaaaaaaaagtgttagcatataggagcctgtgagactccacgtccgcagtagtgttaagaaaaaattacgtccatacttaaaggttaa

SEQ ID NO: 94 - DNA, 258 bp, Artificial sequence
  Synthetic
ttaacccggcgtgattgacgctgggtcacagtgacccagcgcgttttaaaacggccatattttttttatgagttgatcatttgttttaaccgtttaagtagctggagttacgtcccccctctccttagtcggccggtaagtttagtgctacgtcggctgcgcagcgagatacacgtgcgccaagtcaacgcgggtaagtttgacccagcgtcatcgcgggcgtcgtatttttgtggcattccttttttaattaatttt

SEQ ID NO: 95 - DNA, 362 bp, Artificial sequence
  Synthetic
tttcttactatttttaatataaaagtatttttgatctcttatctataacctaagattgttagttcctattattcgtaagaaaagtctattaaaattgttaaaagtagaacaaactaatgaatgttaaattttgaaccttgattttgcatgtgttactttggaaaccaataaaagtatgattgatttaatataatggcataattttattttataacaagcgcagacgaccctttttaacaaataactaaaaaaaataagataacgtcttttatttcgcaaaaaatttactttataatgaggggtaattgtgacccagtgtcattgaccacgtaatttttttcacgtcaatcacgccgggttaa

SEQ ID NO: 96 - DNA, 379 bp, Artificial sequence
  Synthetic
ttaaccctggaatactataccggggtactggattccccgggccatttagtttttctgattttcaggagatggcagcacttatctgattgtgcttccaggtattctcctaactcttaagcatctattcagttgcaggtttgaacttgttctaagtggttgtgttttgtggtatcgctgtcttggggcagtcaattccccagtgtagtgttcatgtaagtataacaaattatagcttttctatcttctataattgagaactgattattgatatttattataagttgtataatgcttttttataattaattattaattaataatgtaaagttgattaattaatcataataattgcattatttcttaattacagctctccaaa

SEQ ID NO: 97 - DNA, 182 bp, Artificial sequence
  Synthetic
aggttattgtagtggaacagaatcctgttaatgtagtagtaagtattgtatttacatattatcattaaagaaagtgtgagtttttacgatattatttttaattattattttccttgtggggcatctagttccccagtgtagtactagtgtcgccagcaacaactgtagtattccagggttaa

SEQ ID NO: 98 - DNA, 378 bp, Artificial sequence
  Synthetic
ttaacccggcatccgacacatggggtatatgaaaccccaacgcatgaaaaacgttcagtacggattaatacttcgggtctatcgggtgctgcgtcctagtagctttaagtgatacattaatccatacatatcgcttctcagtacacttgaccggttggcgtaatatcgagtaggcgtgtttcaaagtcgtctggatttatcacaccccacctgtcgaatctttaaacttttaaacggtttcattgtgttttataataaatattttataattttgctgcttagataaggtaagtgattttacttttagttatggtgatttggattttgtctagttgcacactgttttatctctattttagtaattaatataataatata

SEQ ID NO: 99 - DNA, 354 bp, Artificial sequence
  Synthetic
tatgtggtaacatattgtaaaaattgtagtgacttgagttccacagcatatgaataaaatggtattattatttaatattattattaattaatttactttacttatgctggttgcgcgaaatttatctttcatttttcatacaaacccaatgtaggacaataaacatttttttttactataaattaaattaatcgttatttgacatcatatcaacaacaagtcccaccagaaatctaagaaataagtcccagaaataacaaataaattcaaataaaccgttgtttgagttggggtatatagcaccccacctgtcacaaattgtcacaaaaattcacatgtcggatgccgggttaa

SEQ ID NO: 100 - DNA, 470 bp, Artificial sequence
  Synthetic
ttaacctttaaaaggtaacgtgggggtggaaatacccccacttctaaaaaaagaggtatattttttgtcaggagttggcagcagtcgtgtagttccaggtaccttcctgtgaccttgaagacagtctgtattcagtagagtctcagtgctgacacatcctgtttattcaacataacctccaaaagtgcttggggagtctctgtacccccacgttacccgttgtgtcagcacatttcaccgcatccattcttctatttcttttataaaagtaagtatattatagttttttctgacttgaataactagaattgtagttgttataacctaacctataaactcacattaaatttggccttcgtaaacataaactaacctggatgtgtgttacatagcaatttcatcatgtacgacttgcctttacagttattgtattattttgtcacattctaaactcgtttgtgctttgcaga

SEQ ID NO: 101 - DNA, 339 bp, Artificial sequence
  Synthetic
ctttgggttgtataaaatgtccactcgttgtagtttttttttgtattaacattaattaataaataatattataacacttttagatattattgtaagtttttttttcctataaaatactgtacattttagatatttgtgaaaaaaactcatacacaaaactaaaaaaaaaagaaaaatgatttttttatgattcttgaagtttttcctaacaaaataaacatctaaattaaatcaaaggtccataatgtcttaagtaaatagaaaaaataaatgggggtaatcagacaccccacgttaccatttatattctactttcccatgttacccattaaaggttaa

SEQ ID NO: 102 - DNA, 358 bp, Artificial sequence
  Synthetic
ttaacctttcagtacacgcgcgcggaccgtcactccgcaaaattcaaacggtttaatttgcccgtggcgccatctgttgttgagttgacaagtctcttttccacgtcatccgtagaccgcgtgtgcatttcactgtttactgtttgacagagagtacgaagtaaatagttgttgttaatagtaaatagttgttcttgttttatattattattaagtagattttagttagtgttagttagtaatagtgttttgtgtttagtaaagacttaatagtagtgtaagtaaataggttattgtggagtattgtttggttaaaacaggtaaataaaagtacgatttcattaaattgttgtcttga

SEQ ID NO: 103 - DNA, 201 bp, Artificial sequence
  Synthetic
atatattttgataatttttttaaatgtataaatttattcaattaatttcatactcatataaaaaccaaaaaaaaaaattaaattttataatttttctagcgccatctttcgcctggtggcaaaaatatattttaatgcggactctcagtccggcgcgtgtaatcttgtgtgtattaaaaaccgcgtgtactggaaggttaa

SEQ ID NO: 104 - DNA, 208 bp, Artificial sequence
  Synthetic
ttaaccccttaacctacgattcacgttcgagtgtttcgggcccgaaacgtaaacaaattcgcgcaaccttcgagccattcgcgcgacttgtgtagtacgctgatcgagcctattatctcttcgtatcgtgatcagtttcaagttattcttggtcactttcgcacatcgaaatttactctcataaattctagagaagcagtcccacaag

SEQ ID NO: 105 - DNA, 299 bp, Artificial sequence
  Synthetic
actttttgtagtacttgcatctaccacaattattgcatcaagctgtaattacatatcaaatattccaaaaatgtttataattttaagagggcgccgccgctaatatttatatttgacccgatcatcgtactacgggctatgcccgtaatattcacttctggcccgatcatcgtacacgggctatgcccgtaatatttacgtttggcccgatcagcgtacacgggctatgcccgtaatatttatttttggcccgatcaacgtacacgggctctgctcgtagttgtaggttaaggggttaa

SEQ ID NO: 106 - DNA, 416 bp, Artificial sequence
  Synthetic
ttaagagacattactaaacgaaaggcagtttttctttacacacacacacacacacacacaaaaaacaacaactttgatgcagacttttgcctggttcaggaatcgcgttcgagtaatgaagattacaacttctggaaatcgcaatggggcgaggactcatggatgtcccatggaaacagccattcagctggaactctaactcttatattatgtttatggtcaatttgaccggatttcaatttttgtgttgatcaaagcgcctggttatcctttaaatttaaaaatgtccttttggtttactttattttgataacttctgaagagtcattcagcaccaggtgtgtgtgaaagaggaactttctctccactgtcctgtacactatttccatgccctttctttgagaaatagaccaaaa

SEQ ID NO: 107 - DNA, 272 bp, Artificial sequence
  Synthetic
aaatgtcaaacattgaaaaaccccaaaaaacaggcaagttaaatagttaaagaaaaagtgttaataattaaaatcagaagttgcttaatatagtattgaaattagtttgtttattcttctcatgtctcctaaatgtttgcataatctaagataaagttattattgggttaaattaatttcctgtctgttttgtgttgatttacacaatgcaggtcaaaattacccgcaacataacaaatgtattttttttctcaacataatacaaggattaa

SEQ ID NO: 108 - DNA, 15225 bp, Artificial sequence
  Synthetic
atgggagtgaaggtcctgttcgcactgatttgcatcgccgtggcggaagccgaagtgcaacttgtggaatcggggggaggtttggtgcaacctggaggatcattgagactgtcatgtgcagcctcgggattcaatatcaaggacacttacatccactgggtgcggcaggctccgggaaagggcctggaatgggtggcccggatctaccccaccaacggctacactcgctacgctgactccgtgaagggacgcttcactattagcgcggatacctccaagaacaccgcctacttgcaaatgaactccctccgggccgaggacaccgccgtctactactgctcgcgatgggggggagatggcttctacgcgatggactactggggccaggggacgctcgtcactgtgtcgagcgcatccactaaggggcctagcgtctttccgctggccccgtcctccaagtccacttcgggtggaaccgcggcactggggtgcctcgtgaaggactacttccccgagccggtcaccgtgtcctggaactcgggagccctgacctccggagtgcatactttccctgcggtgctgcagtcctccgggctctactcgctgtcaagcgtggtcaccgtcccgagctcatccctgggtactcagacctacatttgcaacgtgaaccacaaaccttccaacaccaaggtcgacaagaaagtggagcctaagagctgcgacaagacccacacctgtcccccgtgtcccgcccctgagctgctgggcggccccagcgtgttcctcttcccgcctaagccgaaggacactctgatgatctcgagaacccctgaagtgacctgtgtggtggtggatgtgtcccacgaggatccggaagtgaagttcaattggtacgtggacggagtggaagtccataacgccaagaccaagccccgcgaggaacagtacaactcaacttaccgggtggtgtcagtgctgaccgtgctgcaccaagattggctgaacgggaaggagtacaagtgcaaagtctccaacaaggcgctgccggcccccattgaaaagaccatcagcaaggctaagggccagccccgggaaccacaggtctacaccttgcccccttcccgggaggaaatgaccaagaaccaagtgtcgctgacgtgcctggtcaagggcttttatccatctgacatcgccgtggagtgggaaagcaacggccagccggaaaacaactacaagactaccccgcctgtgctggactccgacggctcgttcttcctgtattccaagctcaccgtggataagtccagatggcagcagggcaatgtgttcagctgcagcgtgatgcatgaggccctgcacaaccactacactcagaaatcactgtccctttcccccggaaagtaatgaggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccaccatggacatgagggtccccgctcagctcctggggctcctgctgctctggctcccaggtgccaaatgtgatattcagatgacccaatccccctcctcattgagcgcgtccgtcggagacagagtgaccattacttgtcgcgcctcccaagacgtgaacaccgctgtggcttggtaccagcagaagccgggaaaggcccctaagctgctgatctactctgcctccttcctgtactcgggcgtgccgagccggttcagcgggagccggtcgggaaccgatttcactctgaccatctcgtcactgcaacccgaggactttgccacctactactgccagcagcactacaccactccaccgaccttcggacaaggcaccaaggtcgaaatcaagcgcaccgtggccgcccctagcgtgtttatcttccctccctcggatgagcagcttaagtcaggcaccgcatccgtggtctgcctgctcaacaacttctacccgagggaagccaaagtgcagtggaaagtggacaacgcgctccagtcgggaaactcccaggagtccgtgaccgaacaggactccaaggacagcacttattccctgtcctccactctgacgctgtcaaaggccgactacgagaagcacaaggtctacgcctgcgaagtgacccatcaggggctttcctcgcccgtgactaagagcttcaatcggggcgaatgctaataaaagcttaattaagatccttttccctctgaccagaattatgggaacatcatgaagccccttgagcatctagcttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactccacctaggagatactgaatattgaaaatctcagaaaatgtgacaagttaaattacaaaaaaaaagtgtttgtgaaggaaaaaaatattaaatatagtgttggaataaaaaaatagtattgtttgtctctttcctaaatgttgaaatattctaaaataaagttgatatcagtttaacctgtttttttattgttttgagtggatttacacagtatgggtcaaaatgacccgcaacataatcaaggtaattttttttcaacataatacgagggttaatccgcctaaggtgctggttcttttggtgcttgtattttttttcttcccataatacaaagataattatgaatgtgcctaatgctaaaaagactgttaaaaattaatattttatgtaagtttgttgattatttctaatattttaatgaatactttgtgatttttgatctcatgtgattttgccaaaaattttgctaagtgttttttaaaaacactcaaaagttaattataaataaaaaaattaaacaaaaaacattttattttatttaaaatctatccacaaaagcttattattatacaataaaacctaaaaaccccaaatattttaaaatatgaacatttatatacacgggccgcggaggcccccacgtcagtacttacgtgaaaataattccacctcagtagctaaaggttaagcgagaagattgcgagctgtatcttttcgattatccaaagataatagtattttagttgatttattagtgccttaaattaatgaaagtctgacttcgatctctgcattatatgtaagattgttaattatagaactaagagtttaatttctgttaattaaaattaagcgattttgaataattgttaaataaagatattttcacatacatttacatattttatttattatctgtaataataatacattctaaaagacataaatataaaacaaaattttcctagcttgttcatttgtgtaaaacatgtattttcaatatcgggtttgacagacccaccaggcatgccgtgtgatttttatgtaccaggcatgtcaagggttaagcggccgctcagccttgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttggatatggctcattttttacttcctcaccttgtcgtattatactatgccgatatactatgccgatgattaattgtcgacactgcgggggctctggcgcgccgtttaaacttaaccctcatattatgttaagggtcaatttgacccatttcagtttttggtttgaccaaagaactggttatcctttctttttcttcacgaaagttggtgacttttcctcatctagggtcatgaacttgtgtgtaaaatctggatactgtgaagtgtcgtggaatgtctgtgaacagtttgtatacaaagatgatgttgcgggtcattttgacccacacactttgatgtgagcaagtagctgtccagatccgaaataaacatgtctctttgatgcactttattttgattgctaaattatttatattttgactgtctctgaatagaccttcagatcagagactcaggtgtgtgtgggggaggagctttctctcccttgtccttgtcactgttctcgtgtcatctctttgagaaacagcaaaactgtctaactggtccgatccttaacctttaactgctgaggtgggggcttttcgagcctagcgaaagtgaaattgttcccctcctcccttcccccgcgcgcgacaaacccgtaacttctagtagcttcgatgttagttgcgcctaggccgtcagaagcttcgcacgtgttttcgtgcgcaattcggtaagtaaattcaatttgaaatttgtcgcgggcttcttaggccccacctcagtgtttacgtaacttttttgtaaatagtttcgattaagttattgtgttttttttttgcagtagcttgaaaacgtttgaaaaggctgagttgacgtatctgtttaacccttggcatgcctggtagggtttattagacccaccactttgaaaaacctatgatatttttttaaattgaaggctattgttgacgtgtgttatagtagcttcgcgcaataaaccggcggccattttgacgagcgaacttcagtctcacgtgagcgtgcgtgcgagtagcacgtgtgtaaagtgcgcgcgggcccgtgggaccctaccaggcatacaacgtaacattctgtcggtaagaatattttctttattttttggcatttctttgtttaatgtgttaaattataatacgaaaaaaatattgttgcagtagaagctagcgcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtggtgtcttccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaattattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtactggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgtggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacaggagtgccttaaatttgtctctgcaggcttccggttgtacttgaaaacttcacagaacaccagcttgttgggctcccggcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaggtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggcagcttgcttgttctttttgcagaagctcagaataaacgctcaactttggccgccacc

SEQ ID NO: 109 - DNA, 57 bp, Artificial sequence
  Synthetic
agcttgcttgttctttttgcagaagctcagaataaacgctcaactttggccgccacc

SEQ ID NO: 110 - DNA, 166 bp, Artificial sequence
  Synthetic
gatctttttccctctgccaaaaattatggggacatcatgaagccccttgagcatctgacttctggctaataaaggaaatttattttcattgcaaaaaaaaaaaaaaaaaaaaaaaaaaaaaaaaaaaaaaaaaaaaaaaaaaaaaaaaaaaaaaaaaaaaaaaaaa

SEQ ID NO: 111 - protein, 124 aa, Artificial sequence
  Synthetic
MAKLTSAVPVLTARDVAGAVEFWTDRLGFSRDFVEDDFAGVVRDDVTLFISAVQDQVVPDNTLAWVWVRGLDELYAEWSEVVSTNFRDASGPAMTEIGEQPWGREFALRDPAGNCVHFVAEEQD

SEQ ID NO: 112 - protein, 152 aa, Artificial sequence
  Synthetic
MVAISKNGVIGNGPDIPWSAKGEQLLFKAITYNQWLLVGRKTFESMGALPNRKYAVVTRSSFTSDNEDVLIFPSIKDALTNLKKITDHVIVSGGGEIYKSLIDQVDTLHISTIDIEPEGDVYFPEIPSNFRPVFTQDFASNINYSYQIWQKG

SEQ ID NO: 113 - protein, 187 aa, Artificial sequence
  Synthetic
MVRPLNCIVAVSQNMGIGKNGDLPWPPLRNEFKYFQRMTTTSSVEGKQNLVIMGRKTWFSIPEKNRPLKDRINIVLSRELKEPPRGAHFLAKSLDDALRLIEQPELASKVDMVWIVGGSSVYQEAMNQPGHLRLFVTRIMQEFESDTFFPEIDLGKYKLLPEYPGVLSEVQEEKGIKYKFEVYEKKD

SEQ ID NO: 114 - protein, 264 aa, Artificial sequence
  Synthetic
MIEQDGLHAGSPAAWVERLFGYDWAQQTIGCSDAAVFRLSAQGRPVLFVKTDLSGALNELQDEAARLSWLATTGVPCAAVLDVVTEAGRDWLLLGEVPGQDLLSSHLAPAEKVSIMADAMRRLHTLDPATCPFDHQAKHRIERARTRMEAGLVDQDDLDEEHQGLAPAELFARLKASMPDGEDLVVTHGDACLPNIMVENGRFSGFIDCGRLGVADRYQDIALATRDIAEELGGEWADRFLVLYGIAAPDSQRIAFYRLLDEFF

SEQ ID NO: 115 - protein, 267 aa, Artificial sequence
  Synthetic
MGSAIEQDGLHAGSPAAWVERLFGYDWAQQTIGCSDAAVFRLSAQGRPVLFVKTDLSGALNELQDEAARLSWLATTGVPCAAVLDVVTEAGRDWLLLGEVPGQDLLSSHLAPAEKVSIMADAMRRLHTLDPATCPFDHQAKHRIERARTRMEAGLVDQDDLDEEHQGLAPAELFARLKARMPDGDDLVVTHGDACLPNIMVENGRFSGFIDCGRLGVADRYQDIALATRDIAEELGGEWADRFLVLYGIAAPDSQRIAFYRLLDEFF

SEQ ID NO: 116 - protein, 264 aa, Artificial sequence [sequence omitted]

SEQ ID NO: 117 - protein, 264 aa, Artificial sequence
  Synthetic
MVEQDGLHAGSPAAWVERLFGYDWAQQTIGCSDAAVFRLSAQGRPVLFVKTDLSGALNELQDEAARLSWLATTGVPCAAVLDVVTEAGRDWLLLGEVPGQDLLSSHLAPAEKVSIMADAMRRLHTLDPATCPFDHQAKHRIERARTRMEAGLVDQDDLDEEHQGLAPAELFARLKARMPDGEDLVVTHGDACLPNIMVENGRFSGFIDCGRLGVADRYQDIALATRDIAEELGGEWADRFLVLYGIAAPDSQRIAFYRLLDEFF

SEQ ID NO: 118 - protein, 341 aa, Artificial sequence
  Synthetic
MDRSGKPELTATSVEKFLIEKFDSVSDLMQLSEGEESRAFSFDVGGRGYVLRVNSCADGFYKDRYVYRHFASAALPIPEVLDIGEFSESLTYCISRRAQGVTLQDLPETELPAVLQPVAEAMDAIAAADLSQTSGFGPFGPQGIGQYTTWRDFICAIADPHVYHWQTVMDDTVSASVAQALDELMLWAEDCPEVRHLVHADFGSNNVLTDNGRITAVIDWSEAMFGDSQYEVANIFFWRPWLACMEQQTRYFERRHPELAGSPRLRAYMLRIGLDQLYQSLVDGNFDDAAWAQGRCDAIVRSGAGTVGRTQIARRSAAVWTDGCVEVLADSGNRRPSTRPR

SEQ ID NO: 119 - protein, 341 aa, Artificial sequence
  Synthetic
MKKPELTATSVEKFLIEKFDSVSDLMQLSEGEESRAFSFDVGGRGYVLRVNSCADGFYKDRYVYRHFASAALPIPEVLDIGEFSESLTYCISRRAQGVTLQDLPETELPAVLQPVAEAMDAIAAADLSQTSGFGPFGPQGIGQYTTWRDFICAIADPHVYHWQTVMDDTVSASVAQALDELMLWAEDCPEVRHLVHADFGSNNVLTDNGRITAVIDWSEAMFGDSQYEVANIFFWRPWLACMEQQTRYFERRHPELAGSPRLRAYMLRIGLDQLYQSLVDGNFDDAAWAQGRCDAIVRSGAGTVGRTQIARRSAAVWTDGCVEVLADSGNRRPSTRPRAKE

SEQ ID NO: 120 - protein, 199 aa, Artificial sequence
  Synthetic
MTEYKPTVRLATRDDVPRAVRTLAAAFADYPATRHTVDPDRHIERVTRAARTLPHARRARHRQGVGRATRRRGGGLDHAGERRSGGGVRRDRNAHGRVERFPAGRAATDGRPPGAAPAQGARVVPGHRRRLARPPGQGSGQRRRAPRSGGGRARRGARLPGDLRAPQPPFYERLGFTVTADVECPKDRATWCMTRKPGA

SEQ ID NO: 121 - protein, 199 aa, Artificial sequence
  Synthetic
MTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVECPKDRATWCMTRKPGA

SEQ ID NO: 122 - protein, 199 aa, Artificial sequence
  Synthetic
MTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 123 - DNA, 600 bp, Artificial sequence
  Synthetic
atgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgatataggtaaggtatgggtggcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 124 - protein, 132 aa, Artificial sequence
  Synthetic
MAKPLSQEESTLIERATATINSIPISEDYSVASAALSSDGRIFTGVNVYHFTGGPCAELVVLGTAAAAAAGNLTCIVAIGNENRGILSPCGRCRQVLLDLHPGIKAIVKDSDGQPTAVGIRELLPSGYVWEG

SEQ ID NO: 125 - DNA, 399 bp, Artificial sequence
  Synthetic
atggccaagcctttgtctcaagaagaatccaccctcattgaaagagcaacggctacaatcaacagcatccccatctctgaagattacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaa

SEQ ID NO: 126 - protein, 373 aa, Artificial sequence
  Synthetic
MATSASSHLNKNIKQMYLCLPQGEKVQAMYIWVDGTGEGLRCKTRTLDCEPKCVEELPEWNFDGSSTFQSEGSNSDMYLSPVAMFRDPFRRDPNKLVFCEVFKYNRKPAETNLRHSCKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIRMGDHLWVARFILHRVCEDFGVIATFDPKPIPGNWNGAGCHTNFSTKAMREENGLKHIEEAIEKLSKRHRYHIRAYDPKGGLDNARRLTGFHETSNINDFSAGVANRSASIRIPRTVGQEKKGYFEDRRPSANCDPFAVTEAIVRTCLLNETGDEPFQYKN

SEQ ID NO: 127 - protein, 373 aa, Artificial sequence
  Synthetic
MATSASSHLNKGIKQMYMNLPQGEKIQLMYIWVDGTGEGLRCKTRTLDCDPKCVEELPEWNFDGSSTFQSEGSNSDMYLHPVAMFRDPFRRDPNKLVFCEVFKYNRKPAETNLRHSCKRIMDMVSSQHPWFGMEQEYTLMGTDGHPFGWPSNGFPGPQGPYYCGVGADKAYGRDIVEAHYRACLYAGIKITGTNAEVMPAQWEFQIGPCEGIRMGDHLWVARFILHRVCEDFGVIATFDPKPIPGNWNGAGCHTNFSTKAMREENGLRCIEEAIDKLSKRHQYHIRAYDPKGGLDNARRLTGFHETSNINDFSAGVANRSASIRIPRIVGQEKKGYFEDRRPSANCDPYAVTEAIVRTCLLNETGDEPFQYKN

SEQ ID NO: 128 - protein, 373 aa, Artificial sequence
  Synthetic
MATSASSHLNKGIKQMYMSLPQGEKIQAMYIWVDGTGEGLRCKTRTLDCDPKCVEELPEWNFDGSSTFQSEGSNSDMYLHPVAMFRDPFRKDPNKLVLCEVFKYNRKPAETNLRHICKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIRMGDHLWIARFILHRVCEDFGVIATFDPKPIPGNWNGAGCHTNFSTKAMREENGLKCIEEAIDKLSKRHQYHIRAYDPKGGLDNARRLTGFHETSNINDFSAGVANRSASIRIPRTVGQEKKGYFEDRRPSANCDPYAVTEAIVRTCLLNETGDEPFQYKN

SEQ ID NO: 129 - protein, 373 aa, Artificial sequence
  Synthetic
MATSASSHLNKNIKQMYLCLPQGEKVQAMYIWVDGTGEGLRCKTRTLDCEPKCVEELPEWNFDGSSTFQSEGSNSDMYLSPVAMFRDPFRREPNKLVFCEVFKYNRKPAETNLRHSCKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIHMGDHLWVARFILHRVCEDFGVIATFDPKPIPGNWNGAGCHTNFSTKAMREENGLKHIEEAIEKLSKRHQYHIRAYDPKGGLDNARRLTGFHETSNINDFSAGVANRSASIRIPRTVGQEKKGYFEDRRPSANCDPFAVTEAIVRTCLLNETGDEPFQYKN

SEQ ID NO: 130 - protein, 394 aa, Artificial sequence
  Synthetic
MATSASSHLNKNIKQMYLCLPQGEKVQAMYIWVDGTGEGLRCKTRTLDCEPKCVEELPEWNFDGSSTFQSEGSNSDMYLSPVAMFRDPFRREPNKLVFCEVFKYNRKPAETNLRHSCKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIHMGDHLWVARFILHRVCEDFGVIATFDPKPIPGNWNGAGCHTNFSTKAMREENGLKHIEEAIEKLSKRHQYHIRAYDPKGGLDNARRLTGFHETSNINDFSAGVANRSASIRIPRTVGQEKKGYFEDRRPSANCDPFAVTEAIVRTCLLNETGDEPFQYKNWIRSDMIRYIDEFGQTTTRMQ

SEQ ID NO: 131 - DNA, 1122 bp, Artificial sequence
  Synthetic
atggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagactaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaa

SEQ ID NO: 132 - DNA, 1122 bp, Artificial sequence
  Synthetic
atggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactaa

SEQ ID NO: 133 - DNA, 1122 bp, Artificial sequence
  Synthetic
atggccacctcagcaagttcccacttgaacaaaggcatcaagcaaatgtacatgtccctgccccagggtgagaaaatccaagccatgtatatctgggttgatggtaccggagaaggactgcgctgcaagacccgtaccctggactgtgaccccaagtgtgtggaagagttacctgagtggaactttgatggctctagtacctttcagtctgaaggctccaacagcgacatgtacctccatcctgttgccatgtttcgggaccccttccgcaaagaccccaacaagctggtgctatgtgaagttttcaagtataaccggaagcctgcagaaaccaacttgaggcacatctgtaaacggataatggacatggtgagcaaccagcacccctggtttggaatggagcaggaatatactcttatgggaacagacggccacccatttggttggccttccaatggcttccctggaccccaaggcccgtattactgcggtgtgggagcagacaaggcctacggcagggacatcgtggaggctcactaccgggcctgcttgtatgctggagtcaagatcacggggacaaatgcggaggttatgcctgcccagtgggaattccagataggaccctgtgagggaatccgaatgggagatcatctttggatagcccgttttatcttgcatcgggtgtgcgaagattttggggtgatagcaacctttgaccccaagcccattccagggaactggaatggtgcaggctgccataccaacttcagcaccaaggccatgcgggaggagaatggtctgaagtgcattgaggaggccattgacaaactgagcaagaggcaccagtaccacatccgcgcctacgatcccaaggggggcctggacaacgcccggcgtctgactggattccacgaaacctccaacatcaacgacttttctgccggtgttgccaaccgctccgccagtatccgcattccccggactgtcggccaggagaagaagggctactttgaggaccgtcggccttctgccaattgtgacccctatgcggtgacagaagccatcgtccgcacgtgtctcctcaacgaaacaggcgacgaacccttccaatacaagaactaa

SEQ ID NO: 134 - DNA, 1122 bp, Artificial sequence
  Synthetic
atggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaa

SEQ ID NO: 135 - DNA, 1228 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggttcgaccattgaactgcatcgtcgccgtgtcccaaaatatggggattggcaagaacggagatcttccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaggcgcgccgaagacaa

SEQ ID NO: 136 - DNA, 1026 bp, Artificial sequence
  Synthetic
aagtcttcttaattaacagctgcttcatccccgtggcccgttgctcgcgtttgctggcggtgtccccggaagaaataaatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggaagacac

SEQ ID NO: 137 - DNA, 1712 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggaagacac

SEQ ID NO: 138 - DNA, 1064 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcaggcctggttgaggaacctgttaagacggctccgggaaaaaaggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggaagacac

SEQ ID NO: 139 - DNA, 1358 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggtaaggccactgaactgtattgtggcggtaagtcagaacatgggtataggtaagaatggtgacttgccttggcctccgcttcggaacgaattcaagtatttccaacgcatgactactacctcaagtgtggaaggtaagcaaaatctggtaattatgggacgtaagacctggttttccattcccgaaaagaacaggccactcaaggaccggatcaacatcgtgctctcgcgagaactgaaggagcccccgcgaggtgcgcacttcctggcaaagtcactggacgacgccctgcggctgattgagcagccagagctggcaagtaaggtagatatggtatggatagtaggtgggtcaagtgtgtatcaggaggcgatgaaccagccaggtcacttgaggttgtttgtgactcggatcatgcaagagttcgagtcagacactttcttccccgagatcgacctaggtaagtacaagttactgccagagtacccaggtgtgttaagtgaggtgcaagaggaaaaaggtatcaagtacaagttcgaggtatatgaaaagaaggattaattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactccttaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggaagacac

SEQ ID NO: 140 - DNA, 1358 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggtaaggccactgaactgtattgtggcggtaagtcagaacatgggtataggtaagaatggtgacttgccttggcctccgcttcggaacgaattcaagtatttccaacgcatgactactacctcaagtgtggaaggtaagcaaaatctggtaattatgggacgtaagacctggttttccattcccgaaaagaacaggccactcaaggaccggatcaacatcgtgctctcgcgagaactgaaggagcccccgcgaggtgcgcacttcctggcaaagtcactggacgacgccctgcggctgattgagcagccagagctggcaagtaaggtagatatggtatggatagtaggtgggtcaagtgtgtatcaggaggcgatgaaccagccaggtcacttgaggttgtttgtgactcggatcatgcaagagttcgagtcagacactttcttccccgagatcgacctaggtaagtacaagttactgccagagtacccaggtgtgttaagtgaggtgcaagaggaaaaaggcatcaagtacaagttcgaggtatatgaaaagaaggattaattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactccttaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggaagacac

SEQ ID NO: 141 - DNA, 1712 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagagtacccaggtgtgttaagtgaggtgcaagaggaaaaaggtatcaagtacaagttcgaggtatatgaaaagaaggattaattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggaagacac

SEQ ID NO: 142 - DNA, 1541 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctcatctcgcgcaacctattttcccctcgaacactttttaagccgtagataaacaggctgggacacttcacatggtaaggccactgaactgtattgtggcggtaagtcagaacatgggtataggtaagaatggtgacttgccttggcctccgcttcggaacgaattcaagtatttccaacgcatgactactacctcaagtgtggaaggtaagcaaaatctggtaattatgggacgtaagacctggttttccattcccgaaaagaacaggccactcaaggaccggatcaacatcgtgctctcgcgagaactgaaggagcccccgcgaggtgcgcacttcctggcaaagtcactggacgacgccctgcggctgattgagcagccagagctggcaagtaaggtagatatggtatggatagtaggtgggtcaagtgtgtatcaggaggcgatgaaccagccaggtcacttgaggttgtttgtgactcggatcatgcaagagttcgagtcagacactttcttccccgagatcgacctaggtaagtacaagttactgccagagtacccaggtgtgttaagtgaggtgcaagaggaaaaaggtatcaagtacaagttcgaggtatatgaaaagaaggattaattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactccttaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggaagacac

SEQ ID NO: 143 - DNA, 1321 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggttcgaccattgaactgcatcgtcgccgtgtcccaaaatatggggattggcaagaacggagatcttccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaatggatccgcccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccggcgcgccgaagacaa

SEQ ID NO: 144 - DNA, 1899 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggaagacac

SEQ ID NO: 145 - DNA, 1049 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggttcgaccattgaactgcatcgtcgccgtgtcccaaaatatggggattggcaagaacggagatcttccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaggcgcgccgaagacaa

SEQ ID NO: 146 - DNA, 1472 bp, Artificial sequence
  Synthetic
aagtcttctctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggttcgaccattgaactgcatcgtcgccgtgtcccaaaatatggggattggcaagaacggagatcttccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagaagacaa

SEQ ID NO: 147 - DNA, 1310 bp, Artificial sequence
  Synthetic
gtgtcttctttctttatgttttaaatgcactgatctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttagtctttcttctcgtagacttcaaacttatacttgatgcctttttcctcctggacctcagagaggacgcctgggtattctgggagaagtttatatttccccaaatcaatttctgggaaaaacgtgtcactttcaaattcctgcatgatccttgtcacaaagagtctgaggtggcctggttgattcatggcttcctggtaaacagaactgcctccgactatccaaaccatgtctactttacttgccaattccggttgttcaataagtcttaaggcatcatccaaacttttggcaagaaaatgagctcctcgtggtggttctttgagttctctactgagaactatattaattctgtcctttaaaggtcgattcttctcaggaatggagaaccaggttttcctacccataatcaccagattctgtttaccttccactgaagaggttgtggtcattctttggaagtacttgaactcgttcctgagcggaggccagggcaagtctccgttcttgccaatccccatattttgggacacggcgacgatgcagttcaatggtcgaaccatggtggcgacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtggaagacta

SEQ ID NO: 148 - DNA, 1266 bp, Artificial sequence
  Synthetic
gtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcactatcagcccttctgccaaatctggtagctatagttgatgttcgaggcgaagtcttgggtgaacaccggcctaaagttgctcgggatctcagggaagtacacatctccttcgggttcgatgtcgatggtggagatgtgcagagtgtccacttggtcgatcagtgacttgtagatttcgccccctccggacacaatgacatggtcggtgatcttcttgaggttcgtgagagcgtccttgatcgaagggaagatcagcacatcctcattgtcggaagtgaagctggatctggtcacgacggcgtatttccggttcggcagggcacccatggattcgaaagtcttgcgaccgacaagcaaccactggttgtaggtgatggccttgaacagcagctgctctccctttgcggaccagggaatatctgggccgttcccaatcactccgttctttgaaatcgccaccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctata

SEQ ID NO: 149 - DNA, 1371 bp, Artificial sequence
  Synthetic
gtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcactattagtctttcttctcgtagacttcaaacttatacttgatgcctttttcctcctggacctcagagaggacgcctgggtattctgggagaagtttatatttccccaaatcaatttctgggaaaaacgtgtcactttcaaattcctgcatgatccttgtcacaaagagtctgaggtggcctggttgattcatggcttcctggtaaacagaactgcctccgactatccaaaccatgtctactttacttgccaattccggttgttcaataagtcttaaggcatcatccaaacttttggcaagaaaatgagctcctcgtggtggttctttgagttctctactgagaactatattaattctgtcctttaaaggtcgattcttctcaggaatggagaaccaggttttcctacccataatcaccagattctgtttaccttccactgaagaggttgtggtcattctttggaagtacttgaactcgttcctgagcggaggccagggcaagtctccgttcttgccaatccccatattttgggacacggcgacgatgcagttcaatggtcgaaccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctata

SEQ ID NO: 150 - DNA, 977 bp, Artificial sequence
  Synthetic
aagtcttcttaattaatcccgcccctaactccgcccagttccgcccattctccgccccatggctgactaattttttttatttatgcagaggccgaggccgcctcggcctctgagctattccagaagtagtgaggaggcttttttggaggtataggcttttgcaaaatggttcgaccattgaactgcatcgtcgccgtgtcccaaaatatggggattggcaagaacggagatcttccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaggcgcgccgaagacaa

SEQ ID NO: 151 - DNA, 1796 bp, Artificial sequence
  Synthetic
ttgtcttccccacttctatgatccgcggccgcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggttcgaccattgaactgcatcgtcgccgtgtcccaaaatatggggattggcaagaacggagatcttccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcctgcctcgcgcgtttcggtgatgacggtgaaaacctcaaatcgataatatatggtagggttcatagccagagtaacctttttttttaatttttattttattttatttttgagtcgggcgcgccaaaatgaagtgaagttcctatactttctagatagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatacgaagactt

SEQ ID NO: 152 - DNA, 1819 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacactttatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagactaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggattagaagcgatatgatcagatatatcgacgaattcggtcagaccactacacggatgcaatgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaaaagaagacac

SEQ ID NO: 153 - DNA, 2336 bp, Artificial sequence
  Synthetic
tagtcttcttggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagactaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 154 - DNA, 2571 bp, Artificial sequence
  Synthetic
atgtcttccactgacgggcaccggagcctcacgaagtttgaattgcggcgacagatcaagtttcctctttaattaagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctagcttggggccaccgctcagagcaccttccaccatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagactaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctagcttcgtgtcaaggacggtgactgcagtgaataataaaatgtgtgtttgtccgaaatacgcgttttgagatttctcgaggaagacat

SEQ ID NO: 155 - DNA, 2571 bp, Artificial sequence
  Synthetic
atgtcttcctcgagaaatctcaaaacgcgtatttcggacaaacacacattttattattcactgcagtcaccgtccttgacacgaagctagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaattagtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggtggaaggtgctctgagcggtggccccaagctagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagcttaattaaagaggaaacttgatctgtcgccgcaattcaaacttcgtgaggctccggtgcccgtcagtggaagacat

SEQ ID NO: 156 - DNA, 1765 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagccccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 157 - DNA, 1659 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagccctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 158 - DNA, 1765 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaggcatcaagcaaatgtacatgtccctgccccagggtgagaaaatccaagccatgtatatctgggttgatggtaccggagaaggactgcgctgcaagacccgtaccctggactgtgaccccaagtgtgtggaagagttacctgagtggaactttgatggctctagtacctttcagtctgaaggctccaacagcgacatgtacctccatcctgttgccatgtttcgggaccccttccgcaaagaccccaacaagctggtgctatgtgaagttttcaagtataaccggaagcctgcagaaaccaacttgaggcacatctgtaaacggataatggacatggtgagcaaccagcacccctggtttggaatggagcaggaatatactcttatgggaacagacggccacccatttggttggccttccaatggcttccctggaccccaaggcccgtattactgcggtgtgggagcagacaaggcctacggcagggacatcgtggaggctcactaccgggcctgcttgtatgctggagtcaagatcacggggacaaatgcggaggttatgcctgcccagtgggaattccagataggaccctgtgagggaatccgaatgggagatcatctttggatagcccgttttatcttgcatcgggtgtgcgaagattttggggtgatagcaacctttgaccccaagcccattccagggaactggaatggtgcaggctgccataccaacttcagcaccaaggccatgcgggaggagaatggtctgaagtgcattgaggaggccattgacaaactgagcaagaggcaccagtaccacatccgcgcctacgatcccaaggggggcctggacaacgcccggcgtctgactggattccacgaaacctccaacatcaacgacttttctgccggtgttgccaaccgctccgccagtatccgcattccccggactgtcggccaggagaagaagggctactttgaggaccgtcggccttctgccaattgtgacccctatgcggtgacagaagccatcgtccgcacgtgtctcctcaacgaaacaggcgacgaacccttccaatacaagaactggatccgctcagacatgataagatacattgatgagtttggacaaaccacaactagaatgcagtgataattagactttgagtgatcttgagccccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 159 - DNA, 1765 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagccccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 160 - DNA, 1659 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagccctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 161 - DNA, 1591 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagaagacac

SEQ ID NO: 162 - DNA, 1591 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaggcatcaagcaaatgtacatgtccctgccccagggtgagaaaatccaagccatgtatatctgggttgatggtaccggagaaggactgcgctgcaagacccgtaccctggactgtgaccccaagtgtgtggaagagttacctgagtggaactttgatggctctagtacctttcagtctgaaggctccaacagcgacatgtacctccatcctgttgccatgtttcgggaccccttccgcaaagaccccaacaagctggtgctatgtgaagttttcaagtataaccggaagcctgcagaaaccaacttgaggcacatctgtaaacggataatggacatggtgagcaaccagcacccctggtttggaatggagcaggaatatactcttatgggaacagacggccacccatttggttggccttccaatggcttccctggaccccaaggcccgtattactgcggtgtgggagcagacaaggcctacggcagggacatcgtggaggctcactaccgggcctgcttgtatgctggagtcaagatcacggggacaaatgcggaggttatgcctgcccagtgggaattccagataggaccctgtgagggaatccgaatgggagatcatctttggatagcccgttttatcttgcatcgggtgtgcgaagattttggggtgatagcaacctttgaccccaagcccattccagggaactggaatggtgcaggctgccataccaacttcagcaccaaggccatgcgggaggagaatggtctgaagtgcattgaggaggccattgacaaactgagcaagaggcaccagtaccacatccgcgcctacgatcccaaggggggcctggacaacgcccggcgtctgactggattccacgaaacctccaacatcaacgacttttctgccggtgttgccaaccgctccgccagtatccgcattccccggactgtcggccaggagaagaagggctactttgaggaccgtcggccttctgccaattgtgacccctatgcggtgacagaagccatcgtccgcacgtgtctcctcaacgaaacaggcgacgaacccttccaatacaagaactaatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagaagacac

SEQ ID NO: 163 - DNA, 1591 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactaatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagaagacac

SEQ ID NO: 164 - DNA, 1778 bp, Artificial sequence
  Synthetic
gtgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagacta

SEQ ID NO: 165 - DNA, 1721 bp, Artificial sequence
  Synthetic
ttgtcttcggcgcgcccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataatatatggtagggttcatagccagagtaacctttttttttaatttttattttattttatttttgagtcgggcgcgcaaaaatgaagtgaagttcctatactttctagattaattaagaagactt

SEQ ID NO: 166 - DNA, 2261 bp, Artificial sequence
  Synthetic
ttgtcttcggcgcgcctaccacatttgtaaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctgtagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatacgaaacttgatctgtcgccgcaattcaagcttcgtgaggctccggtgcccgtcagtgacctgctatagaaacttgatctgtcgccgcaattcaagcttcgtgaggctccggtgcccgtcagtgacctgctatactctgaaatcgataatatatggtagggttcatagccagagtaacctttttttttaatttttattttattttatttttgagtcgggcgcgcaaaaatgaagtgaagttcctatactttctagattaattaagaagactt

SEQ ID NO: 167 - DNA, 2192 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 168 - DNA, 2255 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 169 - DNA, 2192 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggacacttcacatggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 170 - DNA, 2255 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggacacttcacatggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 171 - DNA, 1591 bp, Artificial sequence
  Synthetic
gtgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagacta

SEQ ID NO: 172 - DNA, 2264 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 173 - DNA, 2264 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtggactgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 174 - DNA, 2264 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 175 - DNA, 2264 bp, Artificial sequence
  Synthetic
gtgtcttccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaattattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagacta

SEQ ID NO: 176 - DNA, 2264 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaggcatcaagcaaatgtacatgtccctgccccagggtgagaaaatccaagccatgtatatctgggttgatggtaccggagaaggactgcgctgcaagacccgtaccctggactgtgaccccaagtgtgtggaagagttacctgagtggaactttgatggctctagtacctttcagtctgaaggctccaacagcgacatgtacctccatcctgttgccatgtttcgggaccccttccgcaaagaccccaacaagctggtgctatgtgaagttttcaagtataaccggaagcctgcagaaaccaacttgaggcacatctgtaaacggataatggacatggtgagcaaccagcacccctggtttggaatggagcaggaatatactcttatgggaacagacggccacccatttggttggccttccaatggcttccctggaccccaaggcccgtattactgcggtgtgggagcagacaaggcctacggcagggacatcgtggaggctcactaccgggcctgcttgtatgctggagtcaagatcacggggacaaatgcggaggttatgcctgcccagtgggaattccagataggaccctgtgagggaatccgaatgggagatcatctttggatagcccgttttatcttgcatcgggtgtgcgaagattttggggtgatagcaacctttgaccccaagcccattccagggaactggaatggtgcaggctgccataccaacttcagcaccaaggccatgcgggaggagaatggtctgaagtgcattgaggaggccattgacaaactgagcaagaggcaccagtaccacatccgcgcctacgatcccaaggggggcctggacaacgcccggcgtctgactggattccacgaaacctccaacatcaacgacttttctgccggtgttgccaaccgctccgccagtatccgcattccccggactgtcggccaggagaagaagggctactttgaggaccgtcggccttctgccaattgtgacccctatgcggtgacagaagccatcgtccgcacgtgtctcctcaacgaaacaggcgacgaacccttccaatacaagaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 177 - DNA, 1588 bp, Artificial sequence
  Synthetic
gtgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagacta

SEQ ID NO: 178 - DNA, 1910 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactccttaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 179 - DNA, 1973 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactccttaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 180 - DNA, 2533 bp, Artificial sequence
  Synthetic
atgtcttcctcgagaaatctcaaaacgcgtatttcggacaaacacacattttattattcactgcagtcaccgtccttgacacgaagctagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaattagtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagacta

SEQ ID NO: 181 - DNA, 2596 bp, Artificial sequence
  Synthetic
atgtcttcctcgagaaatctcaaaacgcgtatttcggacaaacacacattttattattcactgcagtcaccgtccttgacacgaagctagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaatcattgcatccgtgtagtggtctgaccgaattcgtcgatatatctgatcatatcgcttctaatccagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaattagtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagacta

SEQ ID NO: 182 - DNA, 2160 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactccttaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 183 - DNA, 2067 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 184 - DNA, 1953 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 185 - DNA, 2067 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaggcatcaagcaaatgtacatgtccctgccccagggtgagaaaatccaagccatgtatatctgggttgatggtaccggagaaggactgcgctgcaagacccgtaccctggactgtgaccccaagtgtgtggaagagttacctgagtggaactttgatggctctagtacctttcagtctgaaggctccaacagcgacatgtacctccatcctgttgccatgtttcgggaccccttccgcaaagaccccaacaagctggtgctatgtgaagttttcaagtataaccggaagcctgcagaaaccaacttgaggcacatctgtaaacggataatggacatggtgagcaaccagcacccctggtttggaatggagcaggaatatactcttatgggaacagacggccacccatttggttggccttccaatggcttccctggaccccaaggcccgtattactgcggtgtgggagcagacaaggcctacggcagggacatcgtggaggctcactaccgggcctgcttgtatgctggagtcaagatcacggggacaaatgcggaggttatgcctgcccagtgggaattccagataggaccctgtgagggaatccgaatgggagatcatctttggatagcccgttttatcttgcatcgggtgtgcgaagattttggggtgatagcaacctttgaccccaagcccattccagggaactggaatggtgcaggctgccataccaacttcagcaccaaggccatgcgggaggagaatggtctgaagtgcattgaggaggccattgacaaactgagcaagaggcaccagtaccacatccgcgcctacgatcccaaggggggcctggacaacgcccggcgtctgactggattccacgaaacctccaacatcaacgacttttctgccggtgttgccaaccgctccgccagtatccgcattccccggactgtcggccaggagaagaagggctactttgaggaccgtcggccttctgccaattgtgacccctatgcggtgacagaagccatcgtccgcacgtgtctcctcaacgaaacaggcgacgaacccttccaatacaagaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 186 - DNA, 2067 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 187 - DNA, 1961 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 188 - DNA, 2254 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaggcatcaagcaaatgtacatgtccctgccccagggtgagaaaatccaagccatgtatatctgggttgatggtaccggagaaggactgcgctgcaagacccgtaccctggactgtgaccccaagtgtgtggaagagttacctgagtggaactttgatggctctagtacctttcagtctgaaggctccaacagcgacatgtacctccatcctgttgccatgtttcgggaccccttccgcaaagaccccaacaagctggtgctatgtgaagttttcaagtataaccggaagcctgcagaaaccaacttgaggcacatctgtaaacggataatggacatggtgagcaaccagcacccctggtttggaatggagcaggaatatactcttatgggaacagacggccacccatttggttggccttccaatggcttccctggaccccaaggcccgtattactgcggtgtgggagcagacaaggcctacggcagggacatcgtggaggctcactaccgggcctgcttgtatgctggagtcaagatcacggggacaaatgcggaggttatgcctgcccagtgggaattccagataggaccctgtgagggaatccgaatgggagatcatctttggatagcccgttttatcttgcatcgggtgtgcgaagattttggggtgatagcaacctttgaccccaagcccattccagggaactggaatggtgcaggctgccataccaacttcagcaccaaggccatgcgggaggagaatggtctgaagtgcattgaggaggccattgacaaactgagcaagaggcaccagtaccacatccgcgcctacgatcccaaggggggcctggacaacgcccggcgtctgactggattccacgaaacctccaacatcaacgacttttctgccggtgttgccaaccgctccgccagtatccgcattccccggactgtcggccaggagaagaagggctactttgaggaccgtcggccttctgccaattgtgacccctatgcggtgacagaagccatcgtccgcacgtgtctcctcaacgaaacaggcgacgaacccttccaatacaagaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 189 - DNA, 2254 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 190 - DNA, 2148 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 191 - DNA, 2254 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 192 - DNA, 2148 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 193 - DNA, 2147 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacc

SEQ ID NO: 194 - DNA, 2191 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 195 - DNA, 2085 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 196 - DNA, 2191 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaggcatcaagcaaatgtacatgtccctgccccagggtgagaaaatccaagccatgtatatctgggttgatggtaccggagaaggactgcgctgcaagacccgtaccctggactgtgaccccaagtgtgtggaagagttacctgagtggaactttgatggctctagtacctttcagtctgaaggctccaacagcgacatgtacctccatcctgttgccatgtttcgggaccccttccgcaaagaccccaacaagctggtgctatgtgaagttttcaagtataaccggaagcctgcagaaaccaacttgaggcacatctgtaaacggataatggacatggtgagcaaccagcacccctggtttggaatggagcaggaatatactcttatgggaacagacggccacccatttggttggccttccaatggcttccctggaccccaaggcccgtattactgcggtgtgggagcagacaaggcctacggcagggacatcgtggaggctcactaccgggcctgcttgtatgctggagtcaagatcacggggacaaatgcggaggttatgcctgcccagtgggaattccagataggaccctgtgagggaatccgaatgggagatcatctttggatagcccgttttatcttgcatcgggtgtgcgaagattttggggtgatagcaacctttgaccccaagcccattccagggaactggaatggtgcaggctgccataccaacttcagcaccaaggccatgcgggaggagaatggtctgaagtgcattgaggaggccattgacaaactgagcaagaggcaccagtaccacatccgcgcctacgatcccaaggggggcctggacaacgcccggcgtctgactggattccacgaaacctccaacatcaacgacttttctgccggtgttgccaaccgctccgccagtatccgcattccccggactgtcggccaggagaagaagggctactttgaggaccgtcggccttctgccaattgtgacccctatgcggtgacagaagccatcgtccgcacgtgtctcctcaacgaaacaggcgacgaacccttccaatacaagaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 197 - DNA, 2191 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 198 - DNA, 2085 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaggaatcaagcaaatgtacatgaacctgccccagggtgagaaaatccaactgatgtatatctgggttgatggtactggagaaggactgcgctgcaaaacccgcaccctggactgtgaccccaagtgtgtagaagagttacctgagtggaattttgatggctctagtacctttcagtctgagggctccaacagtgacatgtatctccaccctgttgccatgtttcgggaccccttccgcagagatcccaacaagctggtgttctgtgaagttttcaagtacaaccggaagcctgcagagacaaatttaaggcactcgtgtaaacggataatggacatggtgagctcccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctgggatcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgcggtgcatcgaggaggccatcgacaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggatcgtcggccaggagaagaaaggttactttgaagatcgccgcccctctgccaattgtgacccctacgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 199 - DNA, 1846 bp, Artificial sequence
  Synthetic
tagtcttcttggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 200 - DNA, 2212 bp, Artificial sequence
  Synthetic
tagtcttcttggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaggcatcaagcaaatgtacatgtccctgccccagggtgagaaaatccaagccatgtatatctgggttgatggtaccggagaaggactgcgctgcaagacccgtaccctggactgtgaccccaagtgtgtggaagagttacctgagtggaactttgatggctctagtacctttcagtctgaaggctccaacagcgacatgtacctccatcctgttgccatgtttcgggaccccttccgcaaagaccccaacaagctggtgctatgtgaagttttcaagtataaccggaagcctgcagaaaccaacttgaggcacatctgtaaacggataatggacatggtgagcaaccagcacccctggtttggaatggagcaggaatatactcttatgggaacagacggccacccatttggttggccttccaatggcttccctggaccccaaggcccgtattactgcggtgtgggagcagacaaggcctacggcagggacatcgtggaggctcactaccgggcctgcttgtatgctggagtcaagatcacggggacaaatgcggaggttatgcctgcccagtgggaattccagataggaccctgtgagggaatccgaatgggagatcatctttggatagcccgttttatcttgcatcgggtgtgcgaagattttggggtgatagcaacctttgaccccaagcccattccagggaactggaatggtgcaggctgccataccaacttcagcaccaaggccatgcgggaggagaatggtctgaagtgcattgaggaggccattgacaaactgagcaagaggcaccagtaccacatccgcgcctacgatcccaaggggggcctggacaacgcccggcgtctgactggattccacgaaacctccaacatcaacgacttttctgccggtgttgccaaccgctccgccagtatccgcattccccggactgtcggccaggagaagaagggctactttgaggaccgtcggccttctgccaattgtgacccctatgcggtgacagaagccatcgtccgcacgtgtctcctcaacgaaacaggcgacgaacccttccaatacaagaactggatccgctcagatatgatccgctatatcgacgaattcggccagactaccactcgcatgcaatgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 201 - DNA, 2149 bp, Artificial sequence
  Synthetic
tagtcttcttggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaggcatcaagcaaatgtacatgtccctgccccagggtgagaaaatccaagccatgtatatctgggttgatggtaccggagaaggactgcgctgcaagacccgtaccctggactgtgaccccaagtgtgtggaagagttacctgagtggaactttgatggctctagtacctttcagtctgaaggctccaacagcgacatgtacctccatcctgttgccatgtttcgggaccccttccgcaaagaccccaacaagctggtgctatgtgaagttttcaagtataaccggaagcctgcagaaaccaacttgaggcacatctgtaaacggataatggacatggtgagcaaccagcacccctggtttggaatggagcaggaatatactcttatgggaacagacggccacccatttggttggccttccaatggcttccctggaccccaaggcccgtattactgcggtgtgggagcagacaaggcctacggcagggacatcgtggaggctcactaccgggcctgcttgtatgctggagtcaagatcacggggacaaatgcggaggttatgcctgcccagtgggaattccagataggaccctgtgagggaatccgaatgggagatcatctttggatagcccgttttatcttgcatcgggtgtgcgaagattttggggtgatagcaacctttgaccccaagcccattccagggaactggaatggtgcaggctgccataccaacttcagcaccaaggccatgcgggaggagaatggtctgaagtgcattgaggaggccattgacaaactgagcaagaggcaccagtaccacatccgcgcctacgatcccaaggggggcctggacaacgcccggcgtctgactggattccacgaaacctccaacatcaacgacttttctgccggtgttgccaaccgctccgccagtatccgcattccccggactgtcggccaggagaagaagggctactttgaggaccgtcggccttctgccaattgtgacccctatgcggtgacagaagccatcgtccgcacgtgtctcctcaacgaaacaggcgacgaacccttccaatacaagaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 202 - DNA, 2548 bp, Artificial sequence
  Synthetic
ttgtcttctctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataatatatggtagggttcatagccagagtaacctttttttttaatttttattttattttatttttgagtcgggcgcgccaaaatgaagtgaagttcctatactttctagatagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatacgaagactt

SEQ ID NO: 203 - DNA, 1868 bp, Artificial sequence
  Synthetic
gtgtcttctttctttatgttttaaatgcactgatctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggtggcgacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtggaagacta

SEQ ID NO: 204 - DNA, 1866 bp, Artificial sequence
  Synthetic
tagtcttctctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgtccgccaccatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaatgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 205 - DNA, 2785 bp, Artificial sequence
  Synthetic
aagtcttctctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctagcttcgtgtcaaggacggtgactgcagtgaataataaaatgtgtgtttgtccgaaatacgcgttttgagatttctcgaggaagacat

SEQ ID NO: 206 - DNA, 1971 bp, Artificial sequence
  Synthetic
tagtcttcttggcgaaaacacgcagatgcagtcggggcggcgcggtcccaggtccacttcgcatattaaggtgacgcgtgtggcctcgaacacagagcgactctgcagggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 207 - DNA, 2034 bp, Artificial sequence
  Synthetic
tagtcttcttggcgaaaacacgcagatgcagtcggggcggcgcggtcccaggtccacttcgcatattaaggtgacgcgtgtggcctcgaacacagagcgactctgcagggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 208 - DNA, 2337 bp, Artificial sequence
  Synthetic
tagtcttcttggcgaaaacacgcagatgcagtcggggcggcgcggtcccaggtccacttcgcatattaaggtgacgcgtgtggcctcgaacacagagcgactctgcagggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggacacttcacatggccacctcagcaagttcccacttgaacaaaggcatcaagcaaatgtacatgtccctgccccagggtgagaaaatccaagccatgtatatctgggttgatggtaccggagaaggactgcgctgcaagacccgtaccctggactgtgaccccaagtgtgtggaagagttacctgagtggaactttgatggctctagtacctttcagtctgaaggctccaacagcgacatgtacctccatcctgttgccatgtttcgggaccccttccgcaaagaccccaacaagctggtgctatgtgaagttttcaagtataaccggaagcctgcagaaaccaacttgaggcacatctgtaaacggataatggacatggtgagcaaccagcacccctggtttggaatggagcaggaatatactcttatgggaacagacggccacccatttggttggccttccaatggcttccctggaccccaaggcccgtattactgcggtgtgggagcagacaaggcctacggcagggacatcgtggaggctcactaccgggcctgcttgtatgctggagtcaagatcacggggacaaatgcggaggttatgcctgcccagtgggaattccagataggaccctgtgagggaatccgaatgggagatcatctttggatagcccgttttatcttgcatcgggtgtgcgaagattttggggtgatagcaacctttgaccccaagcccattccagggaactggaatggtgcaggctgccataccaacttcagcaccaaggccatgcgggaggagaatggtctgaagtgcattgaggaggccattgacaaactgagcaagaggcaccagtaccacatccgcgcctacgatcccaaggggggcctggacaacgcccggcgtctgactggattccacgaaacctccaacatcaacgacttttctgccggtgttgccaaccgctccgccagtatccgcattccccggactgtcggccaggagaagaagggctactttgaggaccgtcggccttctgccaattgtgacccctatgcggtgacagaagccatcgtccgcacgtgtctcctcaacgaaacaggcgacgaacccttccaatacaagaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaagacac

SEQ ID NO: 209 - DNA, 1586 bp, Artificial sequence
  Synthetic
accggtcagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaatttaaat

SEQ ID NO: 210 - DNA, 1592 bp, Artificial sequence
  Synthetic
gtaagcaggttaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctgacctgctata

SEQ ID NO: 211 - DNA, 2030 bp, Artificial sequence
  Synthetic
aagtcttctctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagaagacaa

SEQ ID NO: 212 - DNA, 1875 bp, Artificial sequence
  Synthetic
gtgtcttctttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtactggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgtggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacaggagtgccttaaatttgtctctgcaggcttccggttgtacttgaaaacttcacagaacaccagcttgttgggctcccggcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaggtacatttgcttgatgtttttgttcaagtgggaacttgctgaggtggccatggtggcggacgaaaggcccggagatgaggaagaggagaacagcgcggcagacgtgcgcttttgaagcgtgcagaatgccgggcctccggaggaccttcgggcgcccgccccgcccctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtggaagacta

SEQ ID NO: 213 - DNA, 1926 bp, Artificial sequence
  Synthetic
gtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcatcagtttttgtattggaagggctcgtcgccagtctcattgagaaggcatgtgcggacgatggcttctgtcactgcaaaggggtcacaattggcagaggggcggcggtcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcttcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctata

SEQ ID NO: 214 - DNA, 1926 bp, Artificial sequence
  Synthetic
gtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcatcagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctata

SEQ ID NO: 215 - DNA, 678 bp, Artificial sequence
  Synthetic
agtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctg

SEQ ID NO: 216 - DNA, 1535 bp, Artificial sequence
  Synthetic
aagtcttcttaattaatcccgcccctaactccgcccagttccgcccattctccgccccatggctgactaattttttttatttatgcagaggccgaggccgcctcggcctctgagctattccagaagtagtgaggaggcttttttggaggtataggcttttgcaaaatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaggcgcgccgaagacaa

SEQ ID NO: 217 - DNA, 2449 bp, Artificial sequence
  Synthetic
accggtaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacgcagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctacaggtactggcccacagccgtaaagagctgcgggggcgtgagaggggggaatgggtgaggtcaagctggaggcttcttggggttgggtgggccgctgaggggaggggagggcgaggtgacgcgacacccggcctttctgggagagtgggccttgttgacctaaggggggcgagggcagttggcacgcgcacgcgccgacagaaactaacagacattaaccaacagcgattccgtcgcgtttacttgggaggaaggcggaaaagaggtagtttgtgtggcttctggaaaccctaaatttggaatcccagtatgagaatggtgtcccttcttgtgtttcaatgggatttttacttcgcgagtcttgtgggtttggttttgttttcagtttgcctaacaccgtgcttaggtttgaggcagattggagttcggtcgggggagtttgaatatccggaacagttagtggggaaagctgtggacgcttggtaagagagcgctctggattttccgctgttgacgttgaaaccttgaatgacgaatttcgtattaagtgacttagccttgtaaaattgaggggaggcttgcggaatattaacgtatttaaggcattttgaaggaatagttgctaattttgaagaatattaggtgtaaaagcaagaaatacaatgatcctgaggtgacacgcttatgttttacttttaaactaggtcaaaatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaaccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaatttaaat

SEQ ID NO: 218 - DNA, 2455 bp, Artificial sequence
  Synthetic
gtaagcaggttaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccattttgacctagtttaaaagtaaaacataagcgtgtcacctcaggatcattgtatttcttgcttttacacctaatattcttcaaaattagcaactattccttcaaaatgccttaaatacgttaatattccgcaagcctcccctcaattttacaaggctaagtcacttaatacgaaattcgtcattcaaggtttcaacgtcaacagcggaaaatccagagcgctctcttaccaagcgtccacagctttccccactaactgttccggatattcaaactcccccgaccgaactccaatctgcctcaaacctaagcacggtgttaggcaaactgaaaacaaaaccaaacccacaagactcgcgaagtaaaaatcccattgaaacacaagaagggacaccattctcatactgggattccaaatttagggtttccagaagccacacaaactacctcttttccgccttcctcccaagtaaacgcgacggaatcgctgttggttaatgtctgttagtttctgtcggcgcgtgcgcgtgccaactgccctcgccccccttaggtcaacaaggcccactctcccagaaaggccgggtgtcgcgtcacctcgccctcccctcccctcagcggcccacccaaccccaagaagcctccagcttgacctcacccattcccccctctcacgcccccgcagctctttacggctgtgggccagtacctgtagcggataccaggatcctgccaatcaccaaccacgtccacccacagggacacaaacaagctcacccaacaaagccaaccgcccctaaatgctccgggctggcggagcgcaaatttatgcaacgagtgttgcgtcacttatcacccctcacgtagacgccgtctgcgtgcgccgctgaaagtagttcgccgcgcccaacctcccgagaggcagtttaggcttttcaactgagccccaaattcctcatagccgtaagaaaggctcctaaaaaattatttcccttctcctctatgcgcttctcttccttctttaggaaaatataagaaaattatcaggcggatgaatttgagttgaagaaaccttcctcgaaagctctggaaacttacctgctata

SEQ ID NO: 219 - DNA, 2206 bp, Artificial sequence
  Synthetic
aagtcttcttaattaatcccgcccctaactccgcccagttccgcccattctccgccccatggctgactaattttttttatttatgcagaggccgaggccgcctcggcctctgagctattccagaagtagtgaggaggcttttttggaggtataggcttttgcaaaatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggggcgcgccgaagacaa

SEQ ID NO: 220 - DNA, 2366 bp, Artificial sequence
  Synthetic
tagtcttcgttccgcccattctccgccccatggctgactaattttttttatttatgcagaggccgaggccgcctcggcctctgagctattccagaagtagtgaggaggcttttttggaggcctaggcttttgcaaaggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggaagacac

SEQ ID NO: 221 - DNA, 2452 bp, Artificial sequence
  Synthetic
tagtcttcgttccgcccattctccgccccatggctgactaattttttttatttatgcagaggccgaggccgcctcggcctctgagctattccagaagtagtgaggaggcttttttggaggcctaggcttttgcaaaggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggaagacaccgtcaaaagggcgacacaaaatt

SEQ ID NO: 222 - DNA, 1136 bp, Artificial sequence
  Synthetic
gttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttattagccctcccacacataaccagagggcagcaattcacgaatcccaactgccgtcggctgtccatcactgtccttcactatggctttgatcccaggatgcagatcgagaagcacctgtcggcaccgtccgcaggggctcaagatgcccctgttctcatttccgatcgcgacgatacaagtcaggttgccagctgccgcagcagcagcagtgcccagcaccacgagttctgcacaaggtcccccagtaaaatgatatacattgacaccagtgaagatgcggccgtcgctagagagagctgcgctggcgacgctgtaatcttcagagatggggatgctgttgattgtagccgttgctctttcaatgagggtggattcttcttgagacaaaggcttggccatggtggcgacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgta

SEQ ID NO: 223 - DNA, 1055 bp, Artificial sequence
  Synthetic
gtgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagccctcccacacataaccagagggcagcaattcacgaatcccaactgccgtcggctgtccatcactgtccttcactatggctttgatcccaggatgcagatcgagaagcacctgtcggcaccgtccgcaggggctcaagatgcccctgttctcatttccgatcgcgacgatacaagtcaggttgccagctgccgcagcagcagcagtgcccagcaccacgagttctgcacaaggtcccccagtaaaatgatatacattgacaccagtgaagatgcggccgtcgctagagagagctgcgctggcgacgctgtaatcttcagagatggggatgctgttgattgtagccgttgctctttcaatgagggtggattcttcttgagacaaaggcttggccatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagacta

SEQ ID NO: 224 - DNA, 868 bp, Artificial sequence
  Synthetic
gtgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagccctcccacacataaccagagggcagcaattcacgaatcccaactgccgtcggctgtccatcactgtccttcactatggctttgatcccaggatgcagatcgagaagcacctgtcggcaccgtccgcaggggctcaagatgcccctgttctcatttccgatcgcgacgatacaagtcaggttgccagctgccgcagcagcagcagtgcccagcaccacgagttctgcacaaggtcccccagtaaaatgatatacattgacaccagtgaagatgcggccgtcgctagagagagctgcgctggcgacgctgtaatcttcagagatggggatgctgttgattgtagccgttgctctttcaatgagggtggattcttcttgagacaaaggcttggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagacta

SEQ ID NO: 225 - DNA, 1307 bp, Artificial sequence
  Synthetic
aagtcttctctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccaagcctttgtctcaagaagaatccaccctcattgaaagagcaacggctacaatcaacagcatccccatctctgaagattacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagaagacaa

SEQ ID NO: 226 - DNA, 1200 bp, Artificial sequence
  Synthetic
gtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttagccctcccacacataaccagagggcagcaattcacgaatcccaactgccgtcggctgtccatcactgtccttcactatggctttgatcccaggatgcagatcgagaagcacctgtcggcaccgtccgcaggggctcaagatgcccctgttctcatttccgatcgcgacgatacaagtcaggttgccagctgccgcagcagcagcagtgcccagcaccacgagttctgcacaaggtcccccagtaaaatgatatacattgacaccagtgaagatgcggccgtcgctagagagagctgcgctggcgacgctgtaatcttcagagatggggatgctgttgattgtagccgttgctctttcaatgagggtggattcttcttgagacaaaggcttggccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaagcttcgtgaggctccggtgcccgtcagtgacctgctata

SEQ ID NO: 227 - DNA, 1145 bp, Artificial sequence
  Synthetic
gtgtcttctttctttatgttttaaatgcactgatctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttagccctcccacacataaccagagggcagcaattcacgaatcccaactgccgtcggctgtccatcactgtccttcactatggctttgatcccaggatgcagatcgagaagcacctgtcggcaccgtccgcaggggctcaagatgcccctgttctcatttccgatcgcgacgatacaagtcaggttgccagctgccgcagcagcagcagtgcccagcaccacgagttctgcacaaggtcccccagtaaaatgatatacattgacaccagtgaagatgcggccgtcgctagagagagctgcgctggcgacgctgtaatcttcagagatggggatgctgttgattgtagccgttgctctttcaatgagggtggattcttcttgagacaaaggcttggccatggtggcgacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtggaagacta

SEQ ID NO: 228 - DNA, 812 bp, Artificial sequence
  Synthetic
aagtcttcttaattaatcccgcccctaactccgcccagttccgcccattctccgccccatggctgactaattttttttatttatgcagaggccgaggccgcctcggcctctgagctattccagaagtagtgaggaggcttttttggaggtataggcttttgcaaaatggccaagcctttgtctcaagaagaatccaccctcattgaaagagcaacggctacaatcaacagcatccccatctctgaagattacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaggcgcgccgaagacaa

SEQ ID NO: 229 - DNA, 1533 bp, Artificial sequence
  Synthetic
tatagcaggtcactgacgggcaccggagcctcacgaagcttgaattgcggcgacagatcaagtttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatgaaaaagcctgaactcaccgcgacgtctgtcgagaagtttctgatcgaaaagttcgacagcgtgtccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagatctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaaacctgcttac

SEQ ID NO: 230 - DNA, 1827 bp, Artificial sequence
  Synthetic
gtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcagatcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggacacgctgtcgaacttttcgatcagaaacttctcgacagacgtcgcggtgagttcaggctttttcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaagcttcgtgaggctccggtgcccgtcagtgacctgctata

SEQ ID NO: 231 - DNA, 1680 bp, Artificial sequence
  Synthetic
gagtcttcggagacgcgaagaacaacgagaagatcctcaacttctcctaagccttttcactaatagggagaagttcgatggggcagccttgggcagacccacacttctgctccatttccctggttcctgcagctctcagattctcccattttattcgggaagcagctttctggtttctgggtcctggatgtccttggtgcacactccaaggactcctcgtccttaatccatagtctgtattccctgagtcctatcctgggaaccctcatccggtcacttcctcggcgggacaatctcagctcccctccccctctcaggtcggagcccacacgcttggtgcgtgcacatttcaaaaacgaggcgggtccaaaaagagggagggggggaatgagagaggcccagctactcgcggctttacgggtgcacgtagctcaggcctctgcgcccttgagctgggactggatgagccgagcgggaggcggggcgcgcgtcatcagctccccccaccatccagttcctataaatacggactgcagccctccctggtgctctctgctcctccctgttctagagacagccgcatcttcttgtgcagtgccaggctctctgctcctcctgttcgacagtcagccgcatcttcttttgcgtcgccagatgattgaacaagatggattgcacgctggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacatgcccattcgaccaccaagcgaaacatcgcatcgagcgagcacgtactcggatggaagccggtcttgtcgatcaggatgatctggacgaggaacatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaggaacttggcggcgaatgggctgaccgcttcctcgtgctttacggtatcgccgctcccgattcgcagcgcatcgccttctatcgccttcttgacgagttcttctgatgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaaacctgcttacgaagactc

SEQ ID NO: 232 - DNA, 1305 bp, Artificial sequence
  Synthetic
tatagcaggtcactgacgggcaccggagcctcacgaagtttgaattgcggcgacagatcaagtttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatgattgaacaagatggattgcacgctggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacatgcccattcgaccaccaagcgaaacatcgcatcgagcgagcacgtactcggatggaagccggtcttgtcgatcaggatgatctggacgaggaacatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaggaacttggcggcgaatgggctgaccgcttcctcgtgctttacggtatcgccgctcccgattcgcagcgcatcgccttctatcgccttcttgacgagttcttctgatgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaaacctgcttac

SEQ ID NO: 233 - DNA, 1599 bp, Artificial sequence
  Synthetic
gtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcatcagaagaactcgtcaagaaggcgatagaaggcgatgcgctgcgaatcgggagcggcgataccgtaaagcacgaggaagcggtcagcccattcgccgccaagttcctcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgttcctcgtccagatcatcctgatcgacaagaccggcttccatccgagtacgtgctcgctcgatgcgatgtttcgcttggtggtcgaatgggcatgtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaaccagcgtgcaatccatcttgttcaatcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctata

SEQ ID NO: 234 - DNA, 1130 bp, Artificial sequence
  Synthetic
ttgtcttcggcgcgcctcccgcccctaactccgcccagttccgcccattctccgccccatggctgactaattttttttatttatgcagaggccgaggccgcctcggcctctgagctattccagaagtagtgaggaggcttttttggaggtataggcttttgcaaaatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataatatatggtagggttcatagccagagtaacctttttttttaatttttattttattttatttttgagtcgggcgcgcaaaaatgaagtgaagttcctatactttctagattaattaagaagactt

SEQ ID NO: 235 - DNA, 1013 bp, Artificial sequence
  Synthetic
ttgtcttcggcgcgcctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcattttgcaaaagcctatacctccaaaaaagcctcctcactacttctggaatagctcagaggccgaggcggcctcggcctctgcataaataaaaaaaattagtcagccatggggcggagaatgggcggaactgggcggagttaggggcgggattaattaagaagactt

SEQ ID NO: 236 - DNA, 1502 bp, Artificial sequence
  Synthetic
gagtcttcggagacgcgaagaacaacgagaagatcctcaacttctcctaagccttttcactaatagggagaagttcgatggggcagccttgggcagacccacacttctgctccatttccctggttcctgcagctctcagattctcccattttattcgggaagcagctttctggtttctgggtcctggatgtccttggtgcacactccaaggactcctcgtccttaatccatagtctgtattccctgagtcctatcctgggaaccctcatccggtcacttcctcggcgggacaatctcagctcccctccccctctcaggtcggagcccacacgcttggtgcgtgcacatttcaaaaacgaggcgggtccaaaaagagggagggggggaatgagagaggcccagctactcgcggctttacgggtgcacgtagctcaggcctctgcgcccttgagctgggactggatgagccgagcgggaggcggggcgcgcgtcatcagctccccccaccatccagttcctataaatacggactgcagccctccctggtgctctctgctcctccctgttctagagacagccgcatcttcttgtgcagtgccaggctctctgctcctcctgttcgacagtcagccgcatcttcttttgcgtcgccagatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaggcgcgccgaagacac

SEQ ID NO: 237 - DNA, 1256 bp, Artificial sequence
  Synthetic
gtgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagacta

SEQ ID NO: 238 - DNA, 1202 bp, Artificial sequence
  Synthetic
ttgtcttcggcgcgcccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataatatatggtagggttcatagccagagtaacctttttttttaatttttattttattttatttttgagtcgggcgcgcaaaaatgaagtgaagttcctatactttctagattaattaagaagactt

SEQ ID NO: 239 - DNA, 1085 bp, Artificial sequence
  Synthetic
ttgtcttcggcgcgcctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctgttaattaagaagactt

SEQ ID NO: 240 - DNA, 1743 bp, Artificial sequence
  Synthetic
ttgtcttcggcgcgcctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctgtagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatacgaaacttgatctgtcgccgcaattcaagcttcgtgaggctccggtgcccgtcagtgacctgctatagaaacttgatctgtcgccgcaattcaagcttcgtgaggctccggtgcccgtcagtgacctgctatactctgaaatcgataatatatggtagggttcatagccagagtaacctttttttttaatttttattttattttatttttgagtcgggcgcgcaaaaatgaagtgaagttcctatactttctagattaattaagaagactt

SEQ ID NO: 241 - DNA, 1818 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgatataggtaaggtatgggtggcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctagcttcgtgtcaaggacggtgactgcagtgaataataaaatgtgtgtttgtccgaaatacgcgttttgagatttctcgaggaagacat

SEQ ID NO: 242 - DNA, 1734 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagatgacggagtacaagcccacggtaaggctggcaactcgcgacgatgtgcctagggcggtaaggaccctggcggccgcgttcgccgactatccggcaactcgccacacggtggatccggaccggcacatcgagcgggtaactgagctgcaagagctgttcctgacgagagtaggtctggacatcggtaaggtatgggtggctgatgatggtgcggcggtggcggtatggaccaccccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggaagacat

SEQ ID NO: 243 - DNA, 1818 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagatgacggagtacaagcccacggtaaggctggcaactcgcgacgatgtgcctagggcggtaaggaccctggcggccgcgttcgccgactatccggcaactcgccacacggtggatccggaccggcacatcgagcgggtaactgagctgcaagagctgttccttactcgggtaggtctggatataggtaaggtatgggtggctgatgatggtgcggcggtggcggtatggaccaccccagaaagtgtggaggcgggtgcggtgttcgcggagatcgggccacgtatggccgagctgtcaggttccaggttagctgcacagcagcagatggaaggtctgttggccccgcaccggccgaaggagcccgcgtggttcctggcaacggtaggggtaagtccagaccaccaaggtaagggtctgggaagtgcggtggtgttgccaggtgtggaggcggcagagcgggcgggtgtgcctgctttcctcgagactagcgccccgaggaatctgcctttctacgaaagactcggtttcacggtaactgccgatgtggaggtacctgaaggacctcggacctggtgcatgacacgcaagccaggtgcgtgattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctagcttcgtgtcaaggacggtgactgcagtgaataataaaatgtgtgtttgtccgaaatacgcgttttgagatttctcgaggaagacat

SEQ ID NO: 244 - DNA, 2011 bp, Artificial sequence
  Synthetic
tagtcttccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgatataggtaaggtatgggtggcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctagcttcgtgtcaaggacggtgactgcagtgaataataaaatgtgtgtttgtccgaaatacgcgttttgagatttctcgaggaagacat

SEQ ID NO: 245 - DNA, 2011 bp, Artificial sequence; identical to SEQ ID NO: 244
  Synthetic

SEQ ID NO: 246 - DNA, 1344 bp, Artificial sequence
  Synthetic
tagtcttctctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgtccgccaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgatgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 247 - DNA, 1469 bp, Artificial sequence
  Synthetic
ttgtcttcggcgcgcctctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcacacccaagctgtctagagccgccaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataatatatggtagggttcatagccagagtaacctttttttttaatttttattttattttatttttgagtcgggcgcgcaaaaatgaagtgaagttcctatactttctagattaattaagaagactt

SEQ ID NO: 248 - DNA, 2029 bp, Artificial sequence
  Synthetic
ttgtcttctctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataatatatggtagggttcatagccagagtaacctttttttttaatttttattttattttatttttgagtcgggcgcgccaaaatgaagtgaagttcctatactttctagatagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatacgaagactt

SEQ ID NO: 249 - DNA, 1508 bp, Artificial sequence
  Synthetic
ttgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccaagcttgacgaaaggcccggagatgaggaagaggagaacagcgcggcagacgtgcgcttttgaagcgtgcagaatgccgggcctccggaggaccttcgggcgcccgccccgcccctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaagactt

SEQ ID NO: 250 - DNA, 1337 bp, Artificial sequence
  Synthetic
gttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcgacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgta

SEQ ID NO: 251 - DNA, 1349 bp, Artificial sequence
  Synthetic
gtgtcttctttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcgacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtggaagacta

SEQ ID NO: 252 - DNA, 1349 bp, Artificial sequence
  Synthetic
gtgtcttctttctttatgttttaaatgcactgatctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcgacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtggaagacta

SEQ ID NO: 253 - DNA, 2075 bp, Artificial sequence
  Synthetic
ttgtcttcggcgcgccaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacgcagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctacaggtactggcccacagccgtaaagagctgcgggggcgtgagaggggggaatgggtgaggtcaagctggaggcttcttggggttgggtgggccgctgaggggaggggagggcgaggtgacgcgacacccggcctttctgggagagtgggccttgttgacctaaggggggcgagggcagttggcacgcgcacgcgccgacagaaactaacagacattaaccaacagcgattccgtcgcgtttacttgggaggaaggcggaaaagaggtagtttgtgtggcttctggaaaccctaaatttggaatcccagtatgagaatggtgtcccttcttgtgtttcaatgggatttttacttcgcgagtcttgtgggtttggttttgttttcagtttgcctaacaccgtgcttaggtttgaggcagattggagttcggtcgggggagtttgaatatccggaacagttagtggggaaagctgtggacgcttggtaagagagcgctctggattttccgctgttgacgttgaaaccttgaatgacgaatttcgtattaagtgacttagccttgtaaaattgaggggaggcttgcggaatattaacgtatttaaggcattttgaaggaatagttgctaattttgaagaatattaggtgtaaaagcaagaaatacaatgatcctgaggtgacacgcttatgttttacttttaaactaggtcaaaatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataatatatggtagggttcatagccagagtaacctttttttttaatttttattttattttatttttgagtcgggcgcgcaaaaatgaagtgaagttcctatactttctagattaattaagaagactt

SEQ ID NO: 254 - DNA, 1031 bp, Artificial sequence
  Synthetic
gtgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagacta

SEQ ID NO: 255 - DNA, 844 bp, Artificial sequence
  Synthetic
gtgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagacta

SEQ ID NO: 256 - DNA, 1283 bp, Artificial sequence
  Synthetic
aagtcttctctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagaagacaa

SEQ ID NO: 257 - DNA, 1121 bp, Artificial sequence
  Synthetic
gtgtcttctttctttatgttttaaatgcactgatctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggcgacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtggaagacta

SEQ ID NO: 258 - DNA, 788 bp, Artificial sequence
  Synthetic
aagtcttcttaattaatcccgcccctaactccgcccagttccgcccattctccgccccatggctgactaattttttttatttatgcagaggccgaggccgcctcggcctctgagctattccagaagtagtgaggaggcttttttggaggtataggcttttgcaaaatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaggcgcgccgaagacaa

SEQ ID NO: 259 - DNA, 2852 bp, Artificial sequence
  Synthetic
gtgtcttctttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcactattagtctttcttctcgtagacttcaaacttatacttgatgcctttttcctcctggacctcagagaggacgcctgggtattctgggagaagtttatatttccccaaatcaatttctgggaaaaacgtgtcactttcaaattcctgcatgatccttgtcacaaagagtctgaggtggcctggttgattcatggcttcctggtaaacagaactgcctccgactatccaaaccatgtctactttacttgccaattccggttgttcaataagtcttaaggcatcatccaaacttttggcaagaaaatgagctcctcgtggtggttctttgagttctctactgagaactatattaattctgtcctttaaaggtcgattcttctcaggaatggagaaccaggttttcctacccataatcaccagattctgtttaccttccactgaagaggttgtggtcattctttggaagtacttgaactcgttcctgagcggaggccagggcaagtctccgttcttgccaatccccatattttgggacacggcgacgatgcagttcaatggtcgaaccattttgctgtatttaatagtaaaatatactttagtgtgatgattgtggtgtgatccaatggcacaaatccaacaaaagagtaaataatcgctctattgctcaccggatggccaatccaatagctatatggcaacaatctctcaattgtcaccataagcagccagatttggaataaaaggaaacacggacacccaaagtagtcggttccgctgcggagttgcccgttacgacagactgcccactggttcgtgggtatctgctccacagttaggattatccgcattcaggggccggaggactactaactagctcaatagactcttcgcaccatgtctgtattagagcgtcctatgggtcaccccataggcaggccgccagcgcagccaccgccacggtcgcccgtgaggaatgcggtgactcatcgacctgatctacactggggaagtgctgagtgaaacactccgcaactttcatggtgttactaggtttttcgaagtagttagccggataacgaacgttttctccttcaaccgcgtgagcagtctattgatactcggtccggggaaacaggagtgcttgatctagacacggctggtgtgccacgcccactattgatcggtatgaattgcttctaagtttcagtagggggaggggtataaaacaggcacacaaaggtaccgtagtaccagagtgctagcgcccagtgggccctgtgggtgggtacaacccacaggctgttttaatcagaagaactcgtcaagaaggcgatagaaggcgatgcgctgcgaatcgggagcggcgataccgtaaagcacgaggaagcggtcagcccattcgccgccaagttcctcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgttcctcgtccagatcatcctgatcgacaagaccggcttccatccgagtacgtgctcgctcgatgcgatgtttcgcttggtggtcgaatgggcatgtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaaccagcgtgcaatccatcttgttcaatcatggtggcgacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtggaagacta

SEQ ID NO: 260 - DNA, 2121 bp, Artificial sequence
  Synthetic
gtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcactatcagcccttctgccaaatctggtagctatagttgatgttcgaggcgaagtcttgggtgaacaccggcctaaagttgctcgggatctcagggaagtacacatctccttcgggttcgatgtcgatggtggagatgtgcagagtgtccacttggtcgatcagtgacttgtagatttcgccccctccggacacaatgacatggtcggtgatcttcttgaggttcgtgagagcgtccttgatcgaagggaagatcagcacatcctcattgtcggaagtgaagctggatctggtcacgacggcgtatttccggttcggcagggcacccatggattcgaaagtcttgcgaccgacaagcaaccactggttgtaggtgatggccttgaacagcagctgctctccctttgcggaccagggaatatctgggccgttcccaatcactccgttctttgaaatcgccaccatggggccgggattttcctccacgtccccgcatgttagcagacttcccctgccctcagatgtaccgaagaactcgtcaagaaggcgatagaaggcgatgcgctgcgaatcgggagcggcgataccgtaaagcacgaggaagcggtcagcccattcgccgccaagttcctcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgttcctcgtccagatcatcctgatcgacaagaccggcttccatccgagtacgtgctcgctcgatgcgatgtttcgcttggtggtcgaatgggcatgtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaaccagcgtgcaatccatcttgttcaatcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctata

SEQ ID NO: 261 - DNA, 2366 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgattaaaacagcctgtgggttgtacccacccacagggcccactgggcgctagcactctggtactacggtacctttgtgtgcctgttttatacccctccccctactgaaacttagaagcaattcataccgatcaatagtgggcgtggcacaccagccgtgtctagatcaagcactcctgtttccccggaccgagtatcaatagactgctcacgcggttgaaggagaaaacgttcgttatccggctaactacttcgaaaaacctagtaacaccatgaaagttgcggagtgtttcactcagcacttccccagtgtagatcaggtcgatgagtcaccgcattcctcacgggcgaccgtggcggtggctgcgctggcggcctgcctatggggtgacccataggacgctctaatacagacatggtgcgaagagtctattgagctagttagtagtcctccggcccctgaatgcggataatcctaactgtggagcagatacccacgaaccagtgggcagtctgtcgtaacgggcaactccgcagcggaaccgactactttgggtgtccgtgtttccttttattccaaatctggctgcttatggtgacaattgagagattgttgccatatagctattggattggccatccggtgagcaatagagcgattatttactcttttgttggatttgtgccattggatcacaccacaatcatcacactaaagtatattttactattaaatacagcaaaatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaatagtgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 262 - DNA, 2785 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgagaaacccgtatacaccggaccttttctcccctccctctccacttacctttttcccctcttcggcatgaaacaaggattattcaagtggaaacgcgatttaatatgcggctggccaccgcggaataacggcaattgtgtatctgctggaagccaagcctgcctagccgatagcccttgaccgggtgtgtaggatagcccaggaaccagcaatacgcgacaggttatggtagagtagatacctagccaggggcaatgggactgcattgcatatccctaatgaaccattgagatttctctggtcattacccggtgatggttactagaggggggcctctagtactagatctatactgcctgatagggtcgcggctggccgaccatgacctgtatagtcagttgatttgagcaatatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagagtacccaggtgtgttaagtgaggtgcaagaggaaaaaggtatcaagtacaagttcgaggtatatgaaaagaaggattaatggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggaagacac

SEQ ID NO: 263 - DNA, 2222 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgagaaacccgtatacaccggaccttttctcccctccctctccacttacctttttcccctcttcggcatgaaacaaggattattcaagtggaaacgcgatttaatatgcggctggccaccgcggaataacggcaattgtgtatctgctggaagccaagcctgcctagccgatagcccttgaccgggtgtgtaggatagcccaggaaccagcaatacgcgacaggttatggtagagtagatacctagccaggggcaatgggactgcattgcatatccctaatgaaccattgagatttctctggtcattacccggtgatggttactagaggggggcctctagtactagatctatactgcctgatagggtcgcggctggccgaccatgacctgtatagtcagttgatttgagcaatatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaatagtgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 264 - DNA, 2717 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgagaaacccgtatacaccggaccttttctcccctccctctccacttacctttttcccctcttcggcatgaaacaaggattattcaagtggaaacgcgatttaatatgcggctggccaccgcggaataacggcaattgtgtatctgctggaagccaagcctgcctagccgatagcccttgaccgggtgtgtaggatagcccaggaaccagcaatacgcgacaggttatggtagagtagatacctagccaggggcaatgggactgcattgcatatccctaatgaaccattgagatttctctggtcattacccggtgatggttactagaggggggcctctagtactagatctatactgcctgatagggtcgcggctggccgaccatgacctgtatagtcagttgatttgagcaatatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagagtacccaggtgtgttaagtgaggtgcaagaggaaaaaggtatcaagtacaagttcgaggtatatgaaaagaaggattaatggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 265 - DNA, 2553 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgattaaaacagcctgtgggttgtacccacccacagggcccactgggcgctagcactctggtactacggtacctttgtgtgcctgttttatacccctccccctactgaaacttagaagcaattcataccgatcaatagtgggcgtggcacaccagccgtgtctagatcaagcactcctgtttccccggaccgagtatcaatagactgctcacgcggttgaaggagaaaacgttcgttatccggctaactacttcgaaaaacctagtaacaccatgaaagttgcggagtgtttcactcagcacttccccagtgtagatcaggtcgatgagtcaccgcattcctcacgggcgaccgtggcggtggctgcgctggcggcctgcctatggggtgacccataggacgctctaatacagacatggtgcgaagagtctattgagctagttagtagtcctccggcccctgaatgcggataatcctaactgtggagcagatacccacgaaccagtgggcagtctgtcgtaacgggcaactccgcagcggaaccgactactttgggtgtccgtgtttccttttattccaaatctggctgcttatggtgacaattgagagattgttgccatatagctattggattggccatccggtgagcaatagagcgattatttactcttttgttggatttgtgccattggatcacaccacaatcatcacactaaagtatattttactattaaatacagcaaaatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaatagtgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 266 - DNA, 2718 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgacaccatggttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgagaaacccgtatacaccggaccttttctcccctccctctccacttacctttttcccctcttcggcatgaaacaaggattattcaagtggaaacgcgatttaatatgcggctggccaccgcggaataacggcaattgtgtatctgctggaagccaagcctgcctagccgatagcccttgaccgggtgtgtaggatagcccaggaaccagcaatacgcgacaggttatggtagagtagatacctagccaggggcaatgggactgcattgcatatccctaatgaaccattgagatttctctggtcattacccggtgatggttactagaggggggcctctagtactagatctatactgcctgatagggtcgcggctggccgaccatgacctgtatagtcagttgatttgagcaatatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagagtacccaggtgtgttaagtgaggtgcaagaggaaaaaggtatcaagtacaagttcgaggtatatgaaaagaaggattaatggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 267 - DNA, 2718 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggacacttcacatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgagaaacccgtatacaccggaccttttctcccctccctctccacttacctttttcccctcttcggcatgaaacaaggattattcaagtggaaacgcgatttaatatgcggctggccaccgcggaataacggcaattgtgtatctgctggaagccaagcctgcctagccgatagcccttgaccgggtgtgtaggatagcccaggaaccagcaatacgcgacaggttatggtagagtagatacctagccaggggcaatgggactgcattgcatatccctaatgaaccattgagatttctctggtcattacccggtgatggttactagaggggggcctctagtactagatctatactgcctgatagggtcgcggctggccgaccatgacctgtatagtcagttgatttgagcaatatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagagtacccaggtgtgttaagtgaggtgcaagaggaaaaaggtatcaagtacaagttcgaggtatatgaaaagaaggattaatggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaagacac

SEQ ID NO: 268 - DNA, 2979 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggacacttcacatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgagaaacccgtatacaccggaccttttctcccctccctctccacttacctttttcccctcttcggcatgaaacaaggattattcaagtggaaacgcgatttaatatgcggctggccaccgcggaataacggcaattgtgtatctgctggaagccaagcctgcctagccgatagcccttgaccgggtgtgtaggatagcccaggaaccagcaatacgcgacaggttatggtagagtagatacctagccaggggcaatgggactgcattgcatatccctaatgaaccattgagatttctctggtcattacccggtgatggttactagaggggggcctctagtactagatctatactgcctgatagggtcgcggctggccgaccatgacctgtatagtcagttgatttgagcaatatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagagtacccaggtgtgttaagtgaggtgcaagaggaaaaaggtatcaagtacaagttcgaggtatatgaaaagaaggattaatggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgggaagacac

SEQ ID NO: 269 - DNA, 2202 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgaggttaaaaaattccgccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaacgtctaggccccccgaaccacggggacgtggttttcctttgaaaaacacgatgataatatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaatagtgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 270 - DNA, 2035 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgagaaacccgtatacaccggaccttttctcccctccctctccacttacctttttcccctcttcggcatgaaacaaggattattcaagtggaaacgcgatttaatatgcggctggccaccgcggaataacggcaattgtgtatctgctggaagccaagcctgcctagccgatagcccttgaccgggtgtgtaggatagcccaggaaccagcaatacgcgacaggttatggtagagtagatacctagccaggggcaatgggactgcattgcatatccctaatgaaccattgagatttctctggtcattacccggtgatggttactagaggggggcctctagtactagatctatactgcctgatagggtcgcggctggccgaccatgacctgtatagtcagttgatttgagcaatatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaatagtgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 271 - DNA, 2366 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgattaaaacagcctgtgggttgtacccacccacagggcccactgggcgctagcactctggtactacggtacctttgtgtgcctgttttatacccctccccctactgaaacttagaagcaattcataccgatcaatagtgggcgtggcacaccagccgtgtctagatcaagcactcctgtttccccggaccgagtatcaatagactgctcacgcggttgaaggagaaaacgttcgttatccggctaactacttcgaaaaacctagtaacaccatgaaagttgcggagtgtttcactcagcacttccccagtgtagatcaggtcgatgagtcaccgcattcctcacgggcgaccgtggcggtggctgcgctggcggcctgcctatggggtgacccataggacgctctaatacagacatggtgcgaagagtctattgagctagttagtagtcctccggcccctgaatgcggataatcctaactgtggagcagatacccacgaaccagtgggcagtctgtcgtaacgggcaactccgcagcggaaccgactactttgggtgtccgtgtttccttttattccaaatctggctgcttatggtgacaattgagagattgttgccatatagctattggattggccatccggtgaataatagagcgataatatatttgtttgttggattcgtgccacttagtctgaaagttttgagaacactcaactacgttttattgctgaatagtgcaagatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaatagtgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 272 - DNA, 2044 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgagggttttacgaaacccgtatacaccagaccttttctcccctccccctccacctaccttttccccctctttggaccgaaacaaggacacgtaagtggaaacgcgattttatatgtggttggccaccacggaataacggcaattgtctacatgtgggaagtgcaacctccctagccgataacccctgaccgggtgtgtaggataggaaaggtgcccactgtgggcgacaggttatggtagagtggatacctagccaggggcaatgggactgctttgcatatccctaatgaagtattgagatttctctgctcattacccggtgatggttgtgtggggggggccccatacactagatccatactgcctgatagggtcgcggctggccgaccataacctgtatagtcagttgaattcagccaagatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaatagtgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 273 - DNA, 2277 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgagacgaaactaccatcatgcctccccgattatgtgatgctttctgccctgctgggtggagcatcctcgggttgagaaaaccttcttcctttttccttggaccccggtcccccggtctaagccgcttggaataagacagggttatcttcacctcttccttcttctacttcatagtgttctatactatgaaagggtatgtgtcgccccttccttctttggagaacacgcgcggcggtctttccgtctctcgaaaagcgcgtgtgcgacatgcagagaaccgtgaagaaagcagtttgcggactagctttagtgcccacaagaaaacagctgtagcgaccacacaaaggcagcggaccccccctcctggcaacaggagcctctgcggccaaaagccacgtggataagatccacctttgtgtgcggcacaaccccagtgccctggtttcttggtgacacttcagtgaaaacgcaaatggcgatctgaagcgcctctgtaggaaagccaagaatgtccaggaggtaccccttccctcgggaagggatctgacctggagacacatcacatgtgctttacacctgtgcttgtgtttaaaaattgtcacagctttcccaaaccaagtggtcttggttttcactctttaaactgatttcactatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaatagtgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 274 - DNA, 2291 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgagttttacacccccttaccctaatagcaacttagaaggctcaatgcatctacgaccaatagcaggcgcgacggcaccaagtcgtgtctcggtcaagcacttctgtttccccgggaccgagtatcaatagactgctcacgcggttgaaggagaaagcgttcgttacccggccatctacttcgagaagcctagtaacaccatgaaagttgcagagcgtttcgctcagcacttcccccgtgtagatcaggccgatgagtcactgcaaccctcacgggcgaccgtggcagtggctgcgttggcggcctgcccatgggattacccatgggacgctctaatacagacatggtgtgaagaacctattgagctagttggtagtcctccggcccctgaatgcggctaatcctaactgcggagcatacaccctcaatccagggggcagtgtgtcgtaacgggcaactctgcagcggaaccgactactttgggtgtccgtgtttccttttattcttattatggctgcttatggtgacaattgagagattgttgccatatagctattggattggccatccggtgagcaatagagcgattatttactcttttgttggatttgtgccattggatcacaccacaatcatcacactaaagtatattttactattaaatacagcaaaatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagagtacccaggtgtgttaagtgaggtgcaagaggaaaaaggtatcaagtacaagttcgaggtatatgaaaagaaggattaatgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 275 - DNA, 2366 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgattaaaacagcctgtgggttgtacccacccacagggcccactgggcgctagcactctggtactacggtacctttgtgtgcctgttttatacccctccccctactgaaacttagaagcaattcataccgatcaatagtgggcgtggcacaccagccgtgtctagatcaagcactcctgtttccccggaccgagtatcaatagactgctcacgcggttgaaggagaaaacgttcgttatccggctaactacttcgaaaaacctagtaacaccatgaaagttgcggagtgtttcactcagcacttccccagtgtagatcaggtcgatgagtcaccgcattcctcacgggcgaccgtggcggtggctgcgctggcggcctgcctatggggtgacccataggacgctctaatacagacatggtgcgaagagtctattgagctagttagtagtcctccggcccctgaatgcggataatcctaactgtggagcagatacccacgaaccagtgggcagtctgtcgtaacgggcaactccgcagcggaaccgactactttgggtgtccgtgtttccttttattccaaatctggctgcttatggtgacaattgagagattgttgccatatagctattggattggccatccggtgaataatagagcgataatatatttgtttgttggattcgtgccacttagtctgaaagaggttaaaacattacaattcattgttaagttgaatacagcaaaatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaatagtgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 276 - DNA, 2308 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgattaaaacagcctgtgggttgtacccacccacagggcccactgggcgctagcactctggtactacggtacctttgtgtgcctgttttatacccctccccctactgaaacttagaagcaattcataccgatcaatagtgggcgtggcacaccagccgtgtctagatcaagcactcctgtttccccggaccgagtatcaatagactgctcacgcggttgaaggagaaaacgttcgttatccggctaactacttcgaaaaacctagtaacaccatgaaagttgcggagtgtttcactcagcacttccccagtgtagatcaggtcgatgagtcaccgcattcctcacgggcgaccgtggcggtggctgcgctggcggcctgcctatggggtgacccataggacgctctaatacagacatggtgcgaagagtctattgagctagttagtagtcctccggcccctgaatgcggataatcctaactgtggagcagatacccacgaaccagtgggcagtctgtcgtaacgggcaactccgcagcggaaccgactactttgggtgtccgtgtttccttttattccaaatctggctgcttatggtgacaattgagagattgttgccatatagctattggattggccatccggtgaataatagagcgataatatatttgtttgttggattcgtgccacatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagagtacccaggtgtgttaagtgaggtgcaagaggaaaaaggtatcaagtacaagttcgaggtatatgaaaagaaggattaatgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 277 - DNA, 1920 bp, Artificial sequence
  Synthetic
aagtcttcttaattaattggcgaaaacacgcagatgcagtcggggcggcgcggtcccaggtccacttcgcatattaaggtgacgcgtgtggcctcgaacacagagcgactctgcagggtggcatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgagaaacccgtatacaccggaccttttctcccctccctctccacttacctttttcccctcttcggcatgaaacaaggattattcaagtggaaacgcgatttaatatgcggctggccaccgcggaataacggcaattgtgtatctgctggaagccaagcctgcctagccgatagcccttgaccgggtgtgtaggatagcccaggaaccagcaatacgcgacaggttatggtagagtagatacctagccaggggcaatgggactgcattgcatatccctaatgaaccattgagatttctctggtcattacccggtgatggttactagaggggggcctctagtactagatctatactgcctgatagggtcgcggctggccgaccatgacctgtatagtcagttgatttgagcaatatggttcgaccattgaactgcatcgtcgccgtgtcccaaaatatggggattggcaagaacggagacttgccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaatagtgactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaagaagacac

SEQ ID NO: 278 - DNA, 1709 bp, Artificial sequence
  Synthetic
aagtcttcttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgccggtacatctgagggcaggggaagtctgctaacatgcggggacgtggaggaaaatcccggccccatggttcgaccattgaactgcatcgtcgccgtgtcccaaaatatggggattggcaagaacggagatcttccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaggcgcgccgaagacaa

SEQ ID NO: 279 - DNA, 1731 bp, Artificial sequence
  Synthetic
taaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttatcattagtctttcttctcgtagacttcaaacttatacttgatgcctttttcctcctggacctcagagaggacgcctgggtattctgggagaagtttatatttccccaaatcaatttctgggaaaaacgtgtcactttcaaattcctgcatgatccttgtcacaaagagtctgaggtggcctggttgattcatggcttcctggtaaacagaactgcctccgactatccaaaccatgtctactttacttgccaattccggttgttcaataagtcttaaggcatcatccaaacttttggcaagaaaatgagctcctcgtggtggttctttgagttctctactgagaactatattaattctgtcctttaaaggtcgattcttctcaggaatggagaaccaggttttcctacccataatcaccagattctgtttaccttccactgaagaggttgtggtcattctttggaagtacttgaactcgttcctgagcggaggccagggcaagtctccgttcttgccaatccccatattttgggacacggcgacgatgcagttcaatggtcgaaccatggggccgggattttcctccacgtccccgcatgttagcagacttcccctgccctcagatgtaccggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggctctagacagcttgggtgtacctgcgaagcccctgagacggacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggg

SEQ ID NO: 280 - DNA, 2001 bp, Artificial sequence
  Synthetic
gtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttatcattagtctttcttctcgtagacttcaaacttatacttgatgcctttttcctcctggacctcagagaggacgcctgggtattctgggagaagtttatatttccccaaatcaatttctgggaaaaacgtgtcactttcaaattcctgcatgatccttgtcacaaagagtctgaggtggcctggttgattcatggcttcctggtaaacagaactgcctccgactatccaaaccatgtctactttacttgccaattccggttgttcaataagtcttaaggcatcatccaaacttttggcaagaaaatgagctcctcgtggtggttctttgagttctctactgagaactatattaattctgtcctttaaaggtcgattcttctcaggaatggagaaccaggttttcctacccataatcaccagattctgtttaccttccactgaagaggttgtggtcattctttggaagtacttgaactcgttcctgagcggaggccagggcaagtctccgttcttgccaatccccatattttgggacacggcgacgatgcagttcaatggtcgaaccatggggccgggattttcctccacgtccccgcatgttagcagacttcccctgccctcagatgtaccggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggctctagacagcttgggtgtgacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctata

SEQ ID NO: 281 - DNA, 2022 bp, Artificial sequence
  Synthetic
gtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttatcattagtctttcttctcgtagacttcaaacttatacttgatgcctttttcctcctggacctcagagaggacgcctgggtattctgggagaagtttatatttccccaaatcaatttctgggaaaaacgtgtcactttcaaattcctgcatgatccttgtcacaaagagtctgaggtggcctggttgattcatggcttcctggtaaacagaactgcctccgactatccaaaccatgtctactttacttgccaattccggttgttcaataagtcttaaggcatcatccaaacttttggcaagaaaatgagctcctcgtggtggttctttgagttctctactgagaactatattaattctgtcctttaaaggtcgattcttctcaggaatggagaaccaggttttcctacccataatcaccagattctgtttaccttccactgaagaggttgtggtcattctttggaagtacttgaactcgttcctgagcggaggccagggcaagtctccgttcttgccaatccccatattttgggacacggcgacgatgcagttcaatggtcgaaccatggggccgggattttcctccacgtccccgcatgttagcagacttcccctgccctcagatgtaccggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggctctagacagcttgggtgtacctgcgaagcccctgagacggacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctata

SEQ ID NO: 282 - DNA, 1926 bp, Artificial sequence
  Synthetic
gtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcactatcagcccttctgccaaatctggtagctatagttgatgttcgaggcgaagtcttgggtgaacaccggcctaaagttgctcgggatctcagggaagtacacatctccttcgggttcgatgtcgatggtggagatgtgcagagtgtccacttggtcgatcagtgacttgtagatttcgccccctccggacacaatgacatggtcggtgatcttcttgaggttcgtgagagcgtccttgatcgaagggaagatcagcacatcctcattgtcggaagtgaagctggatctggtcacgacggcgtatttccggttcggcagggcacccatggattcgaaagtcttgcgaccgacaagcaaccactggttgtaggtgatggccttgaacagcagctgctctccctttgcggaccagggaatatctgggccgttcccaatcactccgttctttgaaatcgccaccatggggccgggattttcctccacgtccccgcatgttagcagacttcccctgccctcagatgtaccggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctata

SEQ ID NO: 283 - DNA, 2921 bp, Artificial sequence
  Synthetic
tagtcttccactgacgggcaccggagcctcacgaagtttgaattgcggcgacagatcaagtttctctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcacacccaagctgtctagagccgccaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgagaaacccgtatacaccggaccttttctcccctccctctccacttacctttttcccctcttcggcatgaaacaaggattattcaagtggaaacgcgatttaatatgcggctggccaccgcggaataacggcaattgtgtatctgctggaagccaagcctgcctagccgatagcccttgaccgggtgtgtaggatagcccaggaaccagcaatacgcgacaggttatggtagagtagatacctagccaggggcaatgggactgcattgcatatccctaatgaaccattgagatttctctggtcattacccggtgatggttactagaggggggcctctagtactagatctatactgcctgatagggtcgcggctggccgaccatgacctgtatagtcagttgatttgagcaatatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagaagacag

SEQ ID NO: 284 - DNA, 2577 bp, Artificial sequence
  Synthetic
gtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttatcagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggggccgggattttcctccacgtccccgcatgttagcagacttcccctgccctcagatgtaccggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggctctagacagcttgggtgtacctgcgaagcccctgagacggacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctata

SEQ ID NO: 285 - DNA, 2286 bp, Artificial sequence
  Synthetic
taaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttatcagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggggccgggattttcctccacgtccccgcatgttagcagacttcccctgccctcagatgtaccggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggctctagacagcttgggtgtacctgcgaagcccctgagacggacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggg

SEQ ID NO: 286 - DNA, 1296 bp, Artificial sequence
  Synthetic
cagcaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggagacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagacctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtcttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcacgtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtctcgctctggtcttctacgtggaaatgaacgagagccacacgcctgcgtgtgcgagaccgtcccggcaacggcgacgcccacaggcattgcctccttcacggagagagggcctggcacactcaagactcccacggaggttcagttccacactcc

SEQ ID NO: 287 - DNA, 1296 bp, Artificial sequence
  Synthetic
caccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactcc

SEQ ID NO: 288 - DNA, 433 bp, Artificial sequence
  Synthetic
ggcgggagggaaggcgggcagagatggagagaggaacgggagacctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtcttcacccgcgcggttcacagaccgcacatccccaggctgagc

SEQ ID NO: 289 - DNA, 433 bp, Artificial sequence
  Synthetic
ggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagc

SEQ ID NO: 290 - DNA, 65 bp, Artificial sequence
  Synthetic
agaggggcggaagggacgttaggagggaggcagggaggcagggaggcagggaggaacggagggag

SEQ ID NO: 291 - DNA, 1213 bp, Artificial sequence
  Synthetic
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatatt

SEQ ID NO: 292 - DNA, 246 bp, Artificial sequence
  Synthetic
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctt

SEQ ID NO: 293 - DNA, 1536 bp, Artificial sequence
  Synthetic
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagcaggtctggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacctgcccaaggtcttgcataagaggactcttggactttcagcaatgtcatc

SEQ ID NO: 294 - DNA, 726 bp, Artificial sequence
  Synthetic
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatc

SEQ ID NO: 295 - DNA, 726 bp, Artificial sequence
  Synthetic
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagcaggtctggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacctgcccaaggtcttgcataagaggactcttggactttcagcaatgtcatc

SEQ ID NO: 296 - DNA, 810 bp, Artificial sequence
  Synthetic
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagtta

SEQ ID NO: 297 - DNA, 155 bp, Artificial sequence
  Synthetic
ggcatgcttctatattattttctaaaagatttaaagttttgccttctccatttagacttataattcactggaatttttttgtgtgtatggtatgacatatgggttcccttttattttttacatataaatatatttccctgtttttctaaaaaaga

SEQ ID NO: 298 - DNA, 300 bp, Artificial sequence
  Synthetic
ggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagtta

SEQ ID NO: 299 - DNA, 1454 bp, Artificial sequence
  Synthetic
aagctttagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatacaacattttaagaactaagaacctctcttctatgcttagtagatgaacaaaatcatgtaatagatgaatgaggccaggaagtacaaaggtttacaaaattgccaagccactctggggtgattttatgagtaatgcggcatttggtagcttgccttaaagaatattattggacattatcaagtgtgtgtgtgtgtgtgtgtgtgtgtgtgtgtgtgtgtaactgaactctcttgtagtttcatttttgtttgaaaaagacatgtatctcatgtagcccaggctggaatcaaactctatccttctgtctccacctctcaggttctggggttcctggcatgcagcacccaagcccagctacctctgtgaaaactataacttagtaatcagatcctggaccatttaaagaatatatatatatgtatgtgtgtgtgtgtgtatatatataatatatacatatgtatgtatatatacatatatatgtatgtgtatatatgtatgtatagagaggctgactatatatatatatatatatatgaggctgaatatatatatatatatgaatacacatacacatagtgccatggcacattcctttaatctgagctctcaggcaaaggcagaccaatctctgagttgttcaaggccagtgtgatccatagtctcagaaattatatactgagacactcctgaggatgttatcacatttctagtttccttatcttactttaggacatgattccaaaaaaaaggggggggggacacacagtcaatggtagagttacaagactatgccgatgtggtgactcaagaagagagggctgagggagctgaaacaggcatgttcccatgaattccgggcaagcctaggctatagagtgagaccaccatgatttaaaaaaaaaaaaaaagtggcacgcgagaaagtcaacaatgctttgcataagtgttttacctcaaaatcgctgaatagttgactagaacaaattaaaaccttgtccaaagtcaaggccagtgggatcagggactccctccagtcctgaagctt

SEQ ID NO: 300 - DNA, 1260 bp, Artificial sequence
  Synthetic
tagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatacaacattttaagaactaagaacctctcttctatgcttagtagatgaacaaaatcatgtaatagatgaatgaggccaggaagtacaaaggtttacaaaattgccaagccactctggggtgattttatgagtaatgcggcatttggtagcttgccttaaagaatattattggacattatcaagtgtgtgtgtgtgtgtgtgtgtgtgtgtgtgtgtgtgtaactgaactctcttgtagtttcatttttgtttgaaaaagacatgtatctcatgtagcccaggctggaatcaaactctatccttctgtctccacctctcaggttctggggttcctggcatgcagcacccaagcccagctacctctgtgaaaactataacttagtaatcagatcctggaccatttaaagaatatatatatatgtatgtgtgtgtgtgtgtatatatataatatatacatatgtatgtatatatacatatatatgtatgtgtatatatgtatgtatagagaggctgactatatatatatatatatatatgaggctgaatatatatatatatatgaatacacatacacatagtgccatggcacattcctttaatctgagctctcaggcaaaggcagaccaatctctgagttgttcaaggccagtgtgatccatagtctcagaaattatatactgagacactcctgaggatgttatcacatttctagtttccttatcttactttaggacatgattccaaaaaaaaggggggggggacacacagtcaatggtagagttacaagactatgccgatgtggtgactcaagaagagagggctgagggagctgaaacaggcatgttcccatgaattccgg

SEQ ID NO: 301 - DNA, 404 bp, Artificial sequence
  Synthetic
tagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatac

SEQ ID NO: 302 - DNA, 691 bp, Artificial sequence
  Synthetic
tagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatacaacattttaagaactaagaacctctcttctatgcttagtagatgaacaaaatcatgtaatagatgaatgaggccaggaagtacaaaggtttacaaaattgccaagccactctggggtgattttatgagtaatgcggcatttggtagcttgccttaaagaatattattggacattatcaagtgtgtgtgtgtgtgtgtgtgtgtgtgtgtgtgtgtgtaactgaactctcttgtagtttcatttttgtttgaaaaagacatgtatctcatgtagcccaggctggaatc

SEQ ID NO: 303 - DNA, 1454 bp, Artificial sequence
  Synthetic
aagctttagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatacaacattttaagaactaagaacctctcttctatgcttagtagatgaacaaaatcatgtaatagatgaatgaggccaggaagtacaaaggtttacaaaattgccaagccactctggggtgattttatgagtaatgcggcatttggtagcttgccttaaagaatattattggacattatcaagtgtgtgtgtgtgtgtgtgtgtgtgtgtgtgtgtgtgtaactgaactctcttgtagtttcatttttgtttgaaaaagacatgtatctcatgtagcccaggctggaatcaaactctatccttctgtctccacctctcaggttctggggttcctggcatgcagcacccaagcccagctacctctgtgaaaactataacttagtaatcagatcctggaccatttaaagaatatatatatatgtatgtgtgtgtgtgtgtatatatataatatatacatatgtatgtatatatacatatatatgtatgtgtatatatgtatgtatagagaggctgactatatatatatatatatatatgaggctgaatatatatatatatatgaatacacatacacatagtgccatggcacattcctttaatctgagctctcaggcaaaggcagaccaatctctgagttgttcaaggccagtgtgatccatagtctcagaaattatatactgagacactcctgaggatgttatcacatttctagtttccttatcttactttaggacatgattccaaaaaaaaggggggggggacacacagtcaatggtagagttacaagactatgccgatgtggtgactcaagaagagagggctgagggagctgaaacaggcatgttcccatgaattccgggcaagcctaggctatagagtcagaccaccatgatttaaaaaaaaaaaaaaagtggcacgcgagaaagtcaacaatgctttgcataagtgttttacctcaaaatcgctgaatagttgactagaacaaattaaaaccttgtccaaagtcaaggccagtgggatcagggactccctccagtcctgaagctt

SEQ ID NO: 304 - DNA, 293 bp, Artificial sequence
  Synthetic
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattacca

SEQ ID NO: 305 - DNA, 364 bp, Artificial sequence
  Synthetic
actagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattacca

SEQ ID NO: 306 - DNA, 375 bp, Artificial sequence
  Synthetic
attgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattacca

SEQ ID NO: 307 - DNA, 375 bp, Artificial sequence
  Synthetic
attgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattacca

SEQ ID NO: 308 - DNA, 374 bp, Artificial sequence
  Synthetic
attgattattgagtagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacggttagtcatcgctattacca

SEQ ID NO: 309 - DNA, 305 bp, Artificial sequence
  Synthetic
ccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattacca

SEQ ID NO: 310 - DNA, 275 bp, Artificial sequence
  Synthetic
acttacggtaaatggcccgcctggctgaccgcccaacgacccccgcccattgacgtcaatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattgtgcccagtacatgaccttatgggactttcctacttggcagtacatctacgtattagtcatcgctattacca

SEQ ID NO: 311 - DNA, 293 bp, Artificial sequence
  Synthetic
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattacca

SEQ ID NO: 312 - DNA, 292 bp, Artificial sequence
  Synthetic
actacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattacca

SEQ ID NO: 313 - DNA, 293 bp, Artificial sequence
  Synthetic
acttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattacca

SEQ ID NO: 314 - DNA, 412 bp, Artificial sequence
  Synthetic
gtcagtgtacttggctccaatgggtttttcccattgactcatcccctattgaccttatgtactgggcaaaacccaatggaaagtccctattgacgcagtgtacttggctccaatgggactttcctgttgattcaccccctattgaccttatgtactgggcagaatacaatggaaagtccctattgactcacccacattgaccttatatgcttgccaacaatggaaaaacccattggaaagtccctattgagtcagtgtacttggcagcaatgggtttttcccattggctcacctcccattgacccaatgtacttgggcaaaacccagtggaaagtcccatttgactcagtgtgcttgccagtaatgggaaaaacccattggcttacctcccattgacccaatgtacttgggt

SEQ ID NO: 315 - DNA, 294 bp, Artificial sequence
  Synthetic
tgagtcaatagggactttccaatgggttttgcccagtacataaggtcaatgggaggtaagccaatgggtttttcccattactggcacgtatactgagtcattagggactttccaatgggttttgcccagtacataaggtcaataggggtgaatcaacaggaaagttccattggagccaagtacactgagtcaatagggactttccattgggttttgcccagtacaaaaggtcaatagggggtgagtcaatgggtttttcccattattggcacgtacataaggtcaataggggtg

SEQ ID NO: 316 - DNA, 423 bp, Artificial sequence
  Synthetic
gagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacatacataaggtcaataggggtg

SEQ ID NO: 317 - DNA, 412 bp, Artificial sequence; identical to SEQ ID NO: 314
  Synthetic

SEQ ID NO: 318 - DNA, 294 bp, Artificial sequence; identical to SEQ ID NO: 315
  Synthetic

SEQ ID NO: 319 - DNA, 423 bp, Artificial sequence; identical to SEQ ID NO: 316
  Synthetic

SEQ ID NO: 320 - DNA, 206 bp, Artificial sequence
  Synthetic
tatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtg

SEQ ID NO: 321 - DNA, 106 bp, Artificial sequence
  Synthetic
ccattggagccaagtacactgagtcaatagggactttccattgggttttgcccagtacaaaaggtcaatagggggtgagtcaatgggtttttcccattattggcac

SEQ ID NO: 322 - DNA, 292 bp, Artificial sequence
  Synthetic
ttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtat

SEQ ID NO: 323 - DNA, 102 bp, Artificial sequence
  Synthetic
ccagctgttggggtgagtactccctctcaaaagcgggcattacttctgcgctaagattgtcagtttccaaaaacgaggaggatttgatattcacctggcccg

SEQ ID NO: 324 - DNA, 144 bp, Artificial sequence
  Synthetic
ggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaacca

SEQ ID NO: 325 - DNA, 178 bp, Artificial sequence
  Synthetic
gcacatcgcccacagtccccgagaagttggggggaggctctggctgcaggtaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 326 - DNA, 369 bp, Artificial sequence
  Synthetic
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttgggaggggtcggcaattgaaccggtgcctagagaaggtggcgcggggtaaactgggaaagtgatgtcgtgtactggctcagcctttttcccgagggtgggggagaaccgtatataagtgcagtagtcgccgtgaacgttc

SEQ ID NO: 327 - DNA, 369 bp, Artificial sequence
  Synthetic
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 328 - DNA, 372 bp, Artificial sequence
  Synthetic
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 329 - DNA, 372 bp, Artificial sequence
  Synthetic
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 330 - DNA, 372 bp, Artificial sequence
  Synthetic
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 331 - DNA, 570 bp, Artificial sequence
  Synthetic
ctgggctgagacccgcagaggaagacgctctagggatttgtcccggactagcgagatggcaaggctgaggacgggaggctgattgagaggcgaaggtacaccctaatctcaatacaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 332 - DNA, 168 bp, Artificial sequence
  Synthetic
gcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 333 - DNA, 171 bp, Artificial sequence
  Synthetic
gcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 334 - DNA, 171 bp, Artificial sequence
  Synthetic
gcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 335 - DNA, 168 bp, Artificial sequence
  Synthetic
gcacatcgcccacagtccccgagaagttgggaggggtcggcaattgaaccggtgcctagagaaggtggcgcggggtaaactgggaaagtgatgtcgtgtactggctcagcctttttcccgagggtgggggagaaccgtatataagtgcagtagtcgccgtgaacgttc

SEQ ID NO: 336 - DNA, 171 bp, Artificial sequence
  Synthetic
gcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 337 - DNA, 440 bp, Artificial sequence
  Synthetic
agcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgtt

SEQ ID NO: 338 - DNA, 480 bp, Artificial sequence
  Synthetic
agcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcctggggaagtcccagggaccgtcgctaaattctcataacccataatcccggtacccgccccaccacagtgcgaggagcatgcgctcagggctgagcgcggggagagcagagcacacaagctcatagaccctggtcgtggggggaggggcgcactgagcggggggggggggggtgatgggggggaggaccggggagctggcgcggggcaaactgggaaagcggtgtcgtgtgctggctccgccctcttcccgagggtgggggagaacggtatataagtgcggcagtcgccttggacgttc

SEQ ID NO: 339 - DNA, 316 bp, Artificial sequence
  Synthetic
ggagccgagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgtt

SEQ ID NO: 340 - DNA, 503 bp, Artificial sequence
  Synthetic
cctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttc

SEQ ID NO: 341 - DNA, 503 bp, Artificial sequence
  Synthetic
cctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcttcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttc

SEQ ID NO: 342 - DNA, 301 bp, Artificial sequence
  Synthetic
ggagccgagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgtt

SEQ ID NO: 343 - DNA, 459 bp, Artificial sequence
  Synthetic
ggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgtt

SEQ ID NO: 344 - DNA, 600 bp, Artificial sequence
  Synthetic
ggggactctgaaggcaaagacggaggaggagcctgccccgggcgcgtatgggaccagcagaagaagctgttcaaggggtttgtccaggacccgcgagaggtcaaggctgaggacgggaggcgtactgcggggtgaagggataccccaacctggataccatctttgcaaagaaagcaggaacggtggagggaagattctaagcgtccccgcctggccgtctactctccgccccacccccagctgcagctgagagtaattcatacaaaaggaggactcgccttggcctcggggaatcccagggaccgtcggtaaactcccactaacctagaaccgagggctcgctcgtccccgcctcccaccccgcgctctcgtcatcatcggggtcgagaggagcatgcgcaaggcgacgggtgcttttcagtgggctgagcgcacatcgcccacggtccccgaaacgttgggggaggggacggcgattgaacgggtgcccggtggaggtggcgcggggtaaactgggaaagtcgtgtcgtgtgctgactccgccctcttcccgagggtgggggaggaccgtatataagtgccgtagtcctcttgaacgtt

SEQ ID NO: 345 - DNA, 451 bp, Artificial sequence
  Synthetic
gccaggggtgaggccaagacccgcggcagggcgaaggcacaccccagtgtccactcaacctctgtgctaagccacgaagaaaaggaagattctggactgcctttctggcgattcctagccgccccacccccggctggaaccaggagtaattcatacaaaaggaggactcgcctctgccctcgggaatcccagggaccgtcgataaattctcttaatacccgccccgcggcctccgagtcgaggagagcatgggccgccgaactggttgcggatcagggcgccgagcccacagcatcacggtccccgagggcgggggaggggacggcaagggagcaaggccaggaggaggcggcgcggggcaaactgggaaagtggtgtcgtgtgctggctccgccctctttccgagggtgggggagaacggtatataagtgccgtagtcgccctggacgtt

SEQ ID NO: 346 - DNA, 525 bp, Artificial sequence
  Synthetic
gcctggtccggggtgcgagcatcacgcctagaggctcccaacgggccaggtggcaggtgggcgacaggggaaagggacacctcactcttggcggctgagccaggaacggcagaggaacattctgggcgcccctactggccttttcctcgccgccccattcccgggtgaagctgagagtaattcatacagaagaactcgcctttgcctcggggaatcccagggaccgtggttaaactcccactaacttaaaagcgaaggatctccggggccccgcccccggctctcgtcaacctcggggtcgagaggagcatgcgcaaggagctgggtacgggtcagtgggctcagcgcacatcgcccatggtccccgagaactggttggggggaggggagaggggcggtgattgaacgagtgcctactggaggttgcgcggtgtaaactgggaaagtggtgtcgtgtgcgggctccgccctcttcccgagggtgggggagaaccgtatataagtgccgtagtcgccctggacgtt

SEQ ID NO: 347 - DNA, 220 bp, Artificial sequence
  Synthetic
tggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccg

SEQ ID NO: 348 - DNA, 220 bp, Artificial sequence
  Synthetic
tgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccg

SEQ ID NO: 349 - DNA, 220 bp, Artificial sequence
  Synthetic
tagtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccg

SEQ ID NO: 350 - DNA, 220 bp, Artificial sequence
  Synthetic
tggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagcgcgcgtttagtgaaccg

SEQ ID NO: 351 - DNA, 220 bp, Artificial sequence
  Synthetic
tggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccg

SEQ ID NO: 352 - DNA, 314 bp, Artificial sequence
  Synthetic
agtcattgggtttttccagccatttaattaaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcactcattctattggctgagctgcgttctacgtgggtataagaggcgcgaccagcgtcggtaccgtcgcagtcttcggtctgaccaccgtag

SEQ ID NO: 353 - DNA, 313 bp, Artificial sequence
  Synthetic
agtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtag

SEQ ID NO: 354 - DNA, 315 bp, Artificial sequence
  Synthetic
agtcattgggtttttccagccaatttaattaaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttcggtctgaccaccgtag

SEQ ID NO: 355 - DNA, 283 bp, Artificial sequence
  Synthetic
agtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggta

SEQ ID NO: 356 - DNA, 293 bp, Artificial sequence
  Synthetic
aaaggccattgagtcaccacccctatgctgggaaatggtgaacgccccctatgtggaaagtccctatgggccgccattagagtgcatgaccgtgctgattcatatgccatatgagtgtattagggggctttccgcgtgggaaattgggtaaaaagtccccgtattactcacatagggggcgtttggctttgcaaattaggggatttcagtgcatttggcattaaaaactattggttctagtcataaaacgggcggagttaaccatataattgctgtcccccatgccattcgag

SEQ ID NO: 357 - DNA, 238 bp, Artificial sequence
  Synthetic
tactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccg

SEQ ID NO: 358 - DNA, 783 bp, Artificial sequence
  Synthetic
tattaatagcaatcttagctaattaaaatagatagcgtttattgagcgttgggtatcaggcacggtcctaattcttttagatgtctttagttcgtttcactctcccccaaacaatagggtggtattgatcacctccgagcaggtgaaattgaggcacagagaaatcctagtagctggtagaagaacacgcagtgtggtcaagctagcaaggtgtttggtccactgctatatctacaaaacccctaacaatgcctggtgtatagatgctcagtatgcatttgtgggatcagtgattccgatgcctgcttcttataaagtttttatttagaaataattacaggtaaggagttgcaaaaacagtatagtgggatcgagtgtcctttttccctcggcttctcccaggggtatcgtcttacgtaacaatgtccaaacagggaaattgacttgggtataatccacagactctattcaccttgtagattggttttaatagaagtaactggacaacttgtaagctaatatcgttgctatggttctcgttctcagctaaaacggcgctctttactttgtgcacctgaacactgcacaccgagggcgaccaccgcccccgagatgcccagcttctattctagagcgccgcgccggcgccgaatgggttaacgggcggggggacacgcctccgtgcgcttgcgcggcgtcccttcgccccgccttcgcagcgcagtcacatgacccgcccaaccggcgtccgcctataaaaagctgagtgttgacgtcagcgtt

SEQ ID NO: 359 - DNA, 335 bp, Artificial sequence
  Synthetic
ggatccaacttctaagtccgttttttattgatctaaaaggccttttgcgaatcatcttgaaggcaatcgcgttctgagccacctcagctttggcacacagcgcggggactgtcgcgaggggtttagggcccaagcaggacacaccccgaaatctccgcagccacccccaccccacgcccccggctcttgagggttaaatcgcaggcgcaggttctcgcacgcgcacatcatcccgcaggcgagccccagcacccagcccagggtgcgcgcgcgccgtcacgtgacacgcccaaccggcgtcgccgtataaaagcgcgggcgttgacgtcagcggt

SEQ ID NO: 360 - DNA, 335 bp, Artificial sequence
  Synthetic
ggatccaacttctaagtccgttttttattgatctaaaaggccttttgcgaatcatcttgaaggcaatcgcgttctgagccacctcagctttggcacacagcgcggggactgtcgcgaggggtttagggcccaagcaggacacaccccgaaatctccgcagccacccccaccccacgcccccggctcttgagggttaaatcgcaggcgctggttctcgcacgcgcacatcatcccgcaggcgagccccagcacccagcccagggtgcgcgcgcgccgtcacgtgacacgcccaaccggcgtcgccgtataaaagcgcgggcgttgacgtcagcgtt

SEQ ID NO: 361 - DNA, 343 bp, Artificial sequence
  Synthetic
tgacttgggtataatccacagactctattcaccttgtagattggttttaatagaagtaactggacaacttgtaagctaatatcgttgctatggttctcgttctcagctaaaacggcgctctttactttgtgcacctgaacactgcacaccgagggcgaccaccgcccccgagatgcccagcttctattctagagcgccgcgccggcgccgaatgggttaacgggcggggggacacgcctccgtgcgcttgcgcggcgtcccttcgccccgccttcgcagcgcagtcacatgacccgcccaaccggcgtccgcctataaaaagctgagtgttgacgtcagcgtt

SEQ ID NO: 362 - DNA, 329 bp, Artificial sequence
  Synthetic
cggtccgaatttcaaagtctttttcctattgacctacaaggttttcaagaatcatgttgtaagcaactgtgttctgaggaatctatgtttaaaaacccatccgtggatcttggcccagggtccagagactgagctagccacgccccggccgcgccgcagccactcccacggcagttcaagtgttaagtcccaaagaccgcgctctgtgcatgcgcagacccgtccacagctggctcctagccaacccggccggacgagcacccggcgccgtcacgtgacgcacccaaccggcgtcgacctataaaaggccgggcgttgacgtcagcggt

SEQ ID NO: 363 - DNA, 329 bp, Artificial sequence
  Synthetic
cggtccgaatttcaaagtctttttcctattgacctacaaggttttcaagaatcatgttgtaagcaactgtgttctgaggaatctatgtttaaaaacccatccgtggatcttggcccagggtccagagactgagctagccacgccccggccgcgccgcagccactcccacggcagttcaagtgttaagtcccaaagaccgcgctctgtgcatgcgcagacccgtccacagctggctcctagccaacccggccggacgagcacccggcgccgtcacgtgacgcacccaaccggcgtcgacctataaaaggccgggcgttgacgtcagcgtt

SEQ ID NO: 364 - DNA, 325 bp, Artificial sequence
  Synthetic
gggtccgaatttcaaagtcctttttattgacttacaaggttttcaaggaaaatcttggaagtaactgtgttccgaagaatctacgtttaaaaaccgacccctggatctttgccttgggtccaaggaccgagctggccacgccccagccgcgccgcagccactcccaaggcagttcaagtgttaagcccgaaaggtagagctctgcgcatgtgcacacccgtccatagctgggtcccagccaaccaggccggaggagcacccgcgccgtcacgtgacgtgcccaaccggcgtcgacctataaaaggccgggcgttgacgtcagcgg

SEQ ID NO: 365 - DNA, 326 bp, Artificial sequence
  Synthetic
gggtccgaatttcaaagtcctttttattgacttacaaggttttcaaggaaaatcttggaagtaactgtgttccgaagaatctacgtttaaaaaccgacccctggatctttgccttgggtccaaggaccgagctggccacgccccagccgcgccgcagccactcccaaggcagttcaagtgttaagcccgaaaggtagagctctgcgcatgtgcacacccgtccatagctgggtcccagccaaccaggccggaggagcacccgcgccgtcacgtgacgtgcccaaccggcgtcgacctataaaaggccgggcgttgacgtcagcgtt

SEQ ID NO: 366 - DNA, 169 bp, Artificial sequence
  Synthetic
ttcgccccgccttcgcagcgcagtcacatgacccgcccaaccggcgtccgcctataaaaagctgagtgttgacgtcagcgttctcttccgccgtcgtcgccgccatcctcggcgcgactcgcttctttcggttctacctgggagaatccaccgccatccgccaccacca

SEQ ID NO: 367 - DNA, 163 bp, Artificial sequence
  Synthetic
agcccagggtgcgcgcgcgccgtcacgtgacacgcccaaccggcgtcgccgtataaaagcgcgggcgttgacgtcagcgttctcttccgccgcagccgccgccatcgtcggcgcccctcgcacttctcctgtgcccgtgagaatccgtcgccatccgccacca

SEQ ID NO: 368 - DNA, 164 bp, Artificial sequence
  Synthetic
ggccggacgagcacccggcgccgtcacgtgacgcacccaaccggcgtcgacctataaaaggccgggcgttgacgtcagcgttctcttccgccgcagccgccgccatcgtcggcgcgcttccctgttcacctctgactctgagaatccgtcgccatccgccacca

SEQ ID NO: 369 - DNA, 280 bp, Artificial sequence
  Synthetic
tggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgg

SEQ ID NO: 370 - DNA, 282 bp, Artificial sequence
  Synthetic
tggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgg

SEQ ID NO: 371 - DNA, 280 bp, Artificial sequence
  Synthetic
tggtcgaggtgagccccacgttctgcttcactctccccatctcccccccctccccacccccaattttgtatttatttattttttaattattttgtgcagcgatgggggcggggggggggggggcgcgcgccaggtggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgg

SEQ ID NO: 372 - DNA, 283 bp, Artificial sequence
  Synthetic
tgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcggga

SEQ ID NO: 373 - DNA, 270 bp, Artificial sequence
  Synthetic
tctctctttttttttttttttttttttttttttccaaaaggaggggagagggggtaaaaaaatgctgcactgtgcggctaggccggtgagtgagcggcgcggagccaatcagcgctcgccgttccgaaagttgccttttatggctcgagtggccgctgtggcgtcctataaaacccggcggcgcaacgcgcagccactgtcgagtccgcgtccacccgcgagcacaggcctttcgcagctctttcttcgccgctccacacccgccaccag

SEQ ID NO: 374 - DNA, 294 bp, Artificial sequence
  Synthetic
tcaatctcgctttctctctcgctttttttttttttcttcttctttttttttttttttttcaaaaggaggggagagggggtaaaaaaatgctgcactgtgcggcgaggccggtgagtgagcgacgcggagccaatcagcgcccgccgttccgaaagttgccttttatggctcgagtggccgctgtggcgtcctataaaacccggcggcgcaacgcgcagccactgtcgagtcgcgtccacccgcgagcacagcttctttgcagctccttcgttgccggtccacacccgccaccag

SEQ ID NO: 375 - DNA, 230 bp, Artificial sequence
  Synthetic
tcaatctcgctttctctctcgcttttttttttttcttcttctttttttttttttttttcaaaaggaggggagagggggtaaaaaaatgctgcactgtgcggcgaggccggtgagtgagcgacgcggagccaatcagcgcccgccgttccgaaagttgccttttatggctcgagtggccgctgtggcgtcctataaaacccggcggcgcaacgcgcagccactgtcgagtc

SEQ ID NO: 376 - DNA, 308 bp, Artificial sequence
  Synthetic
acctcttcctcaactcacttctctctactctcacttttttttttcttcttcttttttttttttttttttttttttttttttgcaaaagaagggggtaaaaaaatgctgcactgtcgggcgaggccggtgagtgagcgagccggagccaatcagcgcccgccgttccgaaattgccttttatggctcgagtggccgctgtggcgtcctataaaacccggcggcgcaacgcgcgccactgtcgagtccgcgtccacccgcgagtacaacctccttgcagctcctccgtcccggtccacacccgccaccag

SEQ ID NO: 377 - DNA, 253 bp, Artificial sequence
  Synthetic
gcccagcaccccaaggcggccaacgccaaaactctccctcctcctcttcctcaatctcgctctcgctctttttttttttcgcaaaaggaggggagagggggtaaaaaaatgctgcactgtgcggcgaagccggtgagtgagcggcgcggggccaatcagcgtgcgccgttccgaaagttgccttttatggctcgagcggccgcggcggcgccctataaaacccagcggcgcgacgcgccaccaccgccgagtc

SEQ ID NO: 378 - DNA, 61 bp, Artificial sequence
  Synthetic
ttgccttttatggctcgagtggccgctgtggcgtcctataaaacccggcggcgcaacgcgc

SEQ ID NO: 379 - DNA, 494 bp, Artificial sequence
  Synthetic
atgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttc

SEQ ID NO: 380 - DNA, 486 bp, Artificial sequence
  Synthetic
tttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacatctcttcccttctctctccttccaccgcccgttaccgtccctaggaaattttactctgctggagagcttcttctacggcccccttgcagcaatgcacttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaaaacaca

SEQ ID NO: 381 - DNA, 486 bp, Artificial sequence
  Synthetic
tttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaaaacaca

SEQ ID NO: 382 - DNA, 486 bp, Artificial sequence
  Synthetic
tttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctctacccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaaaacaca

SEQ ID NO: 383 - DNA, 843 bp, Artificial sequence
  Synthetic
taccaaaaaacctggagaagttcctcagcttgcccgcctcccagcctttgaaagaataggggaagggggtggcgcgtgctgtccccaggcgaccgggctcaggctccgactccccatgccagccgctcccgggtcgtccgtgcggccccttggcgcggcctgggctcctggacctctctggttcccaccaggatccccatccccgagtctatagtggcttgcgtgcccatagtcccgtcccgggaacctttagccatcactgcccccgcgggccacctcggtcccctccccctctcaggcctgggcccacatgcctggtgcgtgcactggggaacaaggcgggcccgcaaaaagaaaaacgaggaggcccggctactcgcgggtttacgggcgcacgtagctcaggcctcctcgcccttgggctgggactgggcgagcagcacgggaggcggggcgcacgtcacccacgccccgccgcccccagtccctataaattgaggctgcgggttcctccggtgctctctgctccgccccgttcgacaggcagccgcttcttctcgtgcagtgctaggtgaccaaggcagaggccgtgggggcttgggggccggcgggaggagggggcgtgctggccggggcttgggcagccccgaggcggtgctgggcccccagagcggagccgccgggcggggtcccgcattgcaggggcgagcagagtacgtgccgtgccctggggtgggaatggaggccggggggaggggcgccgagggctctggccgctgggctttgccgactgccctgatgctcactctcctctccccacagcgcgtccccgagactgccacc

SEQ ID NO: 384 - DNA, 799 bp, Artificial sequence
  Synthetic
atcctcaacttttccacagcctttgcataaaggggagagggtcggcggtgcagctgtggcacacacgcacttctgctcaacccgcccccccccgcccccgttcctgttccttcccaggttctccccattttatcggggcggcaacttttaggtccctgggtcctggaagtccttagtacacactcttcgtccttaagtccatagtctgtattccctcggtcctatcctgtcccccatcaccgggtcacctccccagcgaagcaatctcagttcccctccccctctcagccccgagcccacacgtttggtgcgtgcacatttcaaaaacgaggcgggtccaaagagagggggtggggaggtgccgagtggcccagctactcgcggctttacgggtgcacgtagctcaggcctcagcgcccttgagctgtgactggatggatgagcggggcgggaggcggggcgagcgtcctcggcgctccccaccaccccagttcctataaatacggactgcagccctccccggtgctctctgctcctccctgttctagagacagccgcatctttccgtgcagtgccaggtgaaaaccgcagagtgggccgcaggtggccggggacggtcggaaacggggaaggggggcgctcagcccgggactgcgggcgctggggcgagctccactgcccgagcccgggctccgcattgcagaggctggagggggaagggatggggggcgcggcggggggcacgctgacctctctttcttctctctccctccgcagcctcgctccggagactgccacc

SEQ ID NO: 385 - DNA, 163 bp, Artificial sequence
  Synthetic
ggagacgccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccag

SEQ ID NO: 386 - DNA, 185 bp, Artificial sequence
  Synthetic
ggagacggcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccag

SEQ ID NO: 387 - DNA, 224 bp, Artificial sequence
  Synthetic
ggagacggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccag

SEQ ID NO: 388 - DNA, 275 bp, Artificial sequence
  Synthetic
ggagacgacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccag

SEQ ID NO: 389 - DNA, 122 bp, Artificial sequence
  Synthetic
ggagacgcgagtcaccgcctgccgccgcgcccccggtttctataaattgagcccgcagcctcccgcttcgctctctgctcctcctgttcgacagtcagccgcatcttcttttgcgtcgccag

SEQ ID NO: 390 - DNA, 167 bp, Artificial sequence
  Synthetic
ggagacgcagctccccccaccatccagttcctataaatacggactgcagccctccctggtgctctctgctcctccctgttctagagacagccgcatcttcttgtgcagtgccaggctctctgctcctcctgttcgacagtcagccgcatcttcttttgcgtcgccag

SEQ ID NO: 391 - DNA, 190 bp, Artificial sequence
  Synthetic
ggagacggcgggaggcggggcgcgcgtcatcagctccccccaccatccagttcctataaatacggactgcagccctccctggtgctctctgctcctccctgttctagagacagccgcatcttcttgtgcagtgccaggctctctgctcctcctgttcgacagtcagccgcatcttcttttgcgtcgccag

SEQ ID NO: 392 - DNA, 211 bp, Artificial sequence
  Synthetic
ggagacgagctgggactggatgagccgagcgggaggcggggcgcgcgtcatcagctccccccaccatccagttcctataaatacggactgcagccctccctggtgctctctgctcctccctgttctagagacagccgcatcttcttgtgcagtgccaggctctctgctcctcctgttcgacagtcagccgcatcttcttttgcgtcgccag

SEQ ID NO: 393 - DNA, 239 bp, Artificial sequence
  Synthetic
ggagacggcacgtagctcaggcctctgcgcccttgagctgggactggatgagccgagcgggaggcggggcgcgcgtcatcagctccccccaccatccagttcctataaatacggactgcagccctccctggtgctctctgctcctccctgttctagagacagccgcatcttcttgtgcagtgccaggctctctgctcctcctgttcgacagtcagccgcatcttcttttgcgtcgccag

SEQ ID NO: 394 - DNA, 278 bp, Artificial sequence
  Synthetic
ggagacggggaatgagagaggcccagctactcgcggctttacgggtgcacgtagctcaggcctctgcgcccttgagctgggactggatgagccgagcgggaggcggggcgcgcgtcatcagctccccccaccatccagttcctataaatacggactgcagccctccctggtgctctctgctcctccctgttctagagacagccgcatcttcttgtgcagtgccaggctctctgctcctcctgttcgacagtcagccgcatcttcttttgcgtcgccag

SEQ ID NO: 395 - DNA, 413 bp, Artificial sequence
  Synthetic
ggagacgtcctatcctgggaaccctcatccggtcacttcctcggcgggacaatctcagctcccctccccctctcaggtcggagcccacacgcttggtgcgtgcacatttcaaaaacgaggcgggtccaaaaagagggagggggggaatgagagaggcccagctactcgcggctttacgggtgcacgtagctcaggcctctgcgcccttgagctgggactggatgagccgagcgggaggcggggcgcgcgtcatcagctccccccaccatccagttcctataaatacggactgcagccctccctggtgctctctgctcctccctgttctagagacagccgcatcttcttgtgcagtgccaggctctctgctcctcctgttcgacagtcagccgcatcttcttttgcgtcgccag

SEQ ID NO: 396 - DNA, 508 bp, Artificial sequence
  Synthetic
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgtc

SEQ ID NO: 397 - DNA, 460 bp, Artificial sequence
  Synthetic
ctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtc

SEQ ID NO: 398 - DNA, 466 bp, Artificial sequence
  Synthetic
cggggttggggttgcgccttttccaaggcagccctgggtttgcgcagggacgcggctgctctgggcgtggttccgggaaacgcagcggcgccgaccctgggcctcgcacattcttcacgtccgttcgcagcgtcacccggatcttcgccgctacccttgtgggccccccggcgacgcttcctcgtccgcccctaagtcgggaaggttccttgcggttcgcggcgtgccggacgtgacaaacggaagccgcacgtctcactagtaccctcgcagacggacagcgccagggagcaatggcagcgcgccgaccgcgatgggctgtggccaatagcggctgctcagcagggcgcgccgagagcagcggccgggaaggggcggtgcgggaggcggggtgtggggcggtagtgtgggccctgttcctgcccgcgcggtgttccgcattctgcaagcctccggagcgcacgtc

SEQ ID NO: 399 - DNA, 458 bp, Artificial sequence
  Synthetic
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgagagcagcggccgggaaggggcggtgcgggaggcggggtgtggggcggtagtgtgggccctgttcctgcccgcgcggtgttccgcattctgcaagcctccggagcgcacgtc

SEQ ID NO: 400 - DNA, 523 bp, Artificial sequence
  Synthetic
cacgggtgggggtgagcgcttttcctaaggcagcctaggactaaagcagcgccacagatactttgggtgtggctcctgaaccgcggctgcagaagctacgggcctctcaaactttccacgtccaagtcgtagcacgacgcagctcccttccgccccacctgcaggtcgctcgatgccgcctctcgctccgcccctagtcaggaaggttcccccgcagctcgcagcgtgccggacgtgacaaatggaagccgcacgtcccaccagtaccctcgcagacggacagcgccttggagcaatggcagcgagccggcccctttgggccagggccaatagcggccgctctgcttggcgcgccctgagccgcggccgggaaggggcggtgcgggaggcggggcgtcggggggcggtgcgggcgcgctcccggtgggcgaggtgctcagcattctgcacgcgtctggacagcgcgtcggtcgcattatccttctctcagtctccaacctctcgccctcgccttattgccacc

SEQ ID NO: 401 - DNA, 527 bp, Artificial sequence
  Synthetic
cacggggttggggttgcgccttttccaaggcagccctgggtttgcgcagggatgcggctgctctgggcgtggttccgggaaacgcagcggcgccgaccttgggtcttgcacattcttcacgtccgttcgcagcgtcacccggatcttcgccgctacccttgtgggccccccggcgacgcttcctgctccgcccctaagtcgggaaggttccttgcggttcgcggcgtgccggacgtgacaaacggaagccgcacctctcactagtaccctcgcagacggacagcgccaaggagcaatggcagcgcgccgaccgcgatgggctgtggccaatagcggctgctcagcagggcgcgccgggagcagcggccgggaaggggcggtgcgggaggcggggtgtggggcggtagtgtggcccctgttcctgcccgcgcggtgttcggcattctgcaagcctccggagcggacgtcagcagtcggctccctcgttgaccgaatcaccgacctctctccccagctgtattgccacc

SEQ ID NO: 402 - DNA, 660 bp, Artificial sequence
  Synthetic
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcac

SEQ ID NO: 403 - DNA, 1092 bp, Artificial sequence
  Synthetic
aagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacgcagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctacaggtactggcccacagccgtaaagagctgcgggggcgtgagaggggggaatgggtgaggtcaagctggaggcttcttggggttgggtgggccgctgaggggaggggagggcgaggtgacgcgacacccggcctttctgggagagtgggccttgttgacctaaggggggcgagggcagttggcacgcgcacgcgccgacagaaactaacagacattaaccaacagcgattccgtcgcgtttacttgggaggaaggcggaaaagaggtagtttgtgtggcttctggaaaccctaaatttggaatcccagtatgagaatggtgtcccttcttgtgtttcaatgggatttttacttcgcgagtcttgtgggtttggttttgttttcagtttgcctaacaccgtgcttaggtttgaggcagattggagttcggtcgggggagtttgaatatccggaacagttagtggggaaagctgtggacgcttggtaagagagcgctctggattttccgctgttgacgttgaaaccttgaatgacgaatttcgtattaagtgacttagccttgtaaaattgaggggaggcttgcggaatattaacgtatttaaggcattttgaaggaatagttgctaattttgaagaatattaggtgtaaaagcaagaaatacaatgatcctgaggtgacacgcttatgttttacttttaaactaggtca

SEQ ID NO: 404 - DNA, 215 bp, Artificial sequence
  Synthetic
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcag

SEQ ID NO: 405 - DNA, 753 bp, Artificial sequence
  Synthetic
aaatgagtcttcggacctcgcgggggccgcttaagcggtggttagggtttgtctgacgcggggggagggggaaggaacgaaacactctcattcggaggcggctcggggtttggtcttggtggccacgggcacgcagaagagcgccgcgatcctcttaagcacccccccgccctccgtggaggcgggggtttggtcggcgggtggtaactggcgggccgctgactcgggcgggtcgcgcgccccagagtgtgaccttttcggtctgctcgcagacccccgggcggcgccgccgcggcggcgacgggctcgctgggtcctaggctccatggggaccgtatacgtggacaggctctggagcatccgcacgactgcggtgatattaccggagaccttctgcgggacgagccgggtcacgcggctgacgcggagcgtccgttgggcgacaaacaccaggacggggcacaggtacactatcttgtcacccggaggcgcgagggactgcaggagcttcagggagtggcgcagctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtcccaggtccacttcgcatattaaggtgacgcgtgtggcctcgaacaccgagcgaccctgcagcgacccgcttaa

SEQ ID NO: 406 - DNA, 270 bp, Artificial sequence
  Synthetic
cagtgtggttttcaagaggaagcaaaaagcctctccacccaggcctggaatgtttccacccaatgtcgagcagtgtggttttgcaagaggaagcaaaaagcctctccacccaggcctggaatgtttccacccaatgtcgagcaaaccccgcccagcgtcttgtcattggcgaattcgaacacgcagatgcagtcggggcggcgcggtcccaggtccacttcgcatattaaggtgacgcgtgtggcctcgaacaccgagcgaccctgcagg

SEQ ID NO: 407 - DNA, 149 bp, Artificial sequence
  Synthetic
tcccgcccctaactccgcccagttccgcccattctccgccccatggctgactaattttttttatttatgcagaggccgaggccgcctcggcctctgagctattccagaagtagtgaggaggcttttttggaggtataggcttttgcaaa

SEQ ID NO: 408 - DNA, 128 bp, Artificial sequence
  Synthetic
gttccgcccattctccgccccatggctgactaattttttttatttatgcagaggccgaggccgcctcggcctctgagctattccagaagtagtgaggaggcttttttggaggcctaggcttttgcaaa

SEQ ID NO: 409 - DNA, 408 bp, Artificial sequence
  Synthetic
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcac

SEQ ID NO: 410 - DNA, 193 bp, Artificial sequence
  Synthetic
ggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcac

SEQ ID NO: 411 - DNA, 318 bp, Artificial sequence
  Synthetic
ctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagagggcggatggtcga

SEQ ID NO: 412 - DNA, 827 bp, Artificial sequence
  Synthetic
gtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagtttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcag

SEQ ID NO: 413 - DNA, 827 bp, Artificial sequence
  Synthetic
gtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcag

SEQ ID NO: 414 - DNA, 825 bp, Artificial sequence
  Synthetic
gtaagtagaccaaggccttttattggctgcggtgttaaggcaagctgcctgtctatccctatctatctactatccacctggctctctagctccatactgcgtacggtgtttgttagcttagggtgatagcaagtagaacgctggtgatggttgctctctatcagtttagcgctggtgatggtggcctccttctccatttcttatatatatatgctggtgatggtccctcttccatggccgcggtgtgcttcggtgccgggtaccgtaacgtggtacagaaaaaggcctgacacgtacgcgtctctccctaggatgctatgtgtctgtagcaccggcggagcttgcgagctcgatgtccaagatagagtctccatgactgctcagatcgtctcctgtgttcacacaccagatattacaagcgacggccgccatgataagtccaaaaatgagcagaatacagaatattgtactcagaggctgcagccatcttggtggcctgctgtggtgctcttttcccgtggaggactccgtcagttcctgcgtgttgttgctcgtactgcgaagatctctcttgccccgtcctgaaaacctaggccctgacagaaaaaagggagagttaggagagggcacagaggattctgtctgtgtcaagggggcttccatgttgtttctttacctgagatctcttccaccagttgttttttatcagcaactgacaggtagtatatcaaaatgagtgcactgatgattattagcactgtatactttagatatcttctggtctctgtggacatctgttgatgataaaaaattatatttttttag

SEQ ID NO: 415 - DNA, 1246 bp, Artificial sequence
  Synthetic
gtaaggttgcattgggctcggctatgggacggggatttggcccggtactttaatatgggtggggtcttatgggtagggggcttattaatataacgccccctacccatacatattgcgtcacgtaattagaagccccctaccacgccattggcgcccgcccatagcggtactttcggttctatacaagatggctaccgcggttttcgatcgctcccgggggtctcatttctatagctggaaagcatccgacccccatgatctgtgccttagaccccagggtacgtgcctggataggtgggcgacccctagcggctgcttgtatttttatatcagagatcgaaaatcacagccgcccgtaacagctgtcagggctatacaagatggcgaccgctactttcgatcgctttttcttccctcgatcctgcttccgaaacgcaacccacccccggggtatgtgccttagaccctatagatgccccccaggacgcaggaaaaattttagctcccctctataattttattcgagcgatcgaaatccgcggaccgcccgggtttttactttcgttttctcggtcgccgctcggctcggattccgagcagaaaaagggctagaaagctgcgctcacctgccgaaacgcgttgttcggatcatcccgggagggccagcgtagtctccgttgctgggttcggccgagggatcgagtcgagcgggcggcgggacgccgggaacgagagaggatcgggagcgggcgcccgggtggctcgggagcggccgggagacggtctgcagagctccagagctgcgtgtcctgacactgaacagttgggaaaaatactggatcttataatgacccaggggaaggggtccgagatcctcccagtgtccgagactgccaagagacactcctgttgaaaagcagctctaaaacgttttcctgctcatctctgccagacccccgcccactgacagagctcaattgatagcagatgtcctctttggaaggacacacgcttccacaaacaccgttcctcactgaggtgcattgtctgggagggaaggtcaccttcttgttcattgtggacggtgtgcggcccaggcctcggacgaccctggcccgggcttccttcttcctgatccaggtagattgacgtgcggacatcgcgaacgaccgcagtcttcctgatctttgaatgactcgagtacatgagcgcacctttcgagactgatctctcttgttctccatag

SEQ ID NO: 416 - DNA, 1246 bp, Artificial sequence
  Synthetic
gtaaggttgcattgggctcggctatgggacggggatttggcccggtactttaatatgggtggggtcttatgggtagggggcttattaatataacgccccctacccatacatattgcgtcacgtaattagaagccccctaccacgccattggcgcccgcccatagcggtactttcggttctatacaagatggctaccgcggttttcgatcgctcccgggggtcacatttctatagctggaaagcatccgacccccatgatctgtgccttagaccccagggtacgtgcctggataggtgggcgacccctagcggctgcttgtatttttatatcagagatcgaaaatcacagccgcccgtaacagctgtcagggctatacaagatggcgaccgctactttcgatcgctttttcttccctcgatcctgcttccgaaacgcaacccacccccggggtatgtgccttagaccctatagatgccccccaggacgcaggaaaaattttagctcccctctataattttattcgagcgatcgaaatccgcggaccgcccgggtttttactttcgttttctcggtcgccgctcggctcggattccgagcagaaaaagggctagaaagctgcgctctcctgccgaaacgcgttgttcggatcatcccgggagggccagcgtagtctccgttgctgggttcggccgagggatcgagtcgagcgggcggcgggacgccgggaacgagagaggatcgggagcgggcgcccgggtggctcgggagcggccgggagagggtctgcagagctccagagctgcgtgtcctgacactgaacagttgggaaaaatactggatcttataatgacccaggggaaggggtccgagatcctcccagtgtccgagactgccaagagacactcctgttgaaaagcagctctaaaacgttttcctgctcatctctgccagacccccgcccactgacagagctcaattgatagcagatgtcctctttggaaggacacacgcttccacaaacaccgttcctcactgaggtgcattgtctgggagggaaggtcaccttcttgttcattgtggacggtgtgcggcccaggcctcggacgaccctggcccgggcttccttcttcctgatccaggtagattgacgtgcggacatcgcgaacgaccgcagtgttcctgatctttgaatgactcgagtacatgagcgcacctttcgagactgatctctcttgttctccatag

SEQ ID NO: 417 - DNA, 114 bp, Artificial sequence
  Synthetic
gtacgtgtcggggtttgtgccccccctttttttttaataaaattgtattaatgttatatacatatctcctgtatgtgacccatgtgcttatgactctatttctcatgtgtttag

SEQ ID NO: 418 - DNA, 170 bp, Artificial sequence
  Synthetic
gtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacag

SEQ ID NO: 419 - DNA, 122 bp, Artificial sequence
  Synthetic
gtgagtgtctcagttattcacatcatgactcttctaactatcttatctcctctacctgtctctgtctttcatattcacccacacagaacacttgagttatacaaaccactcttatattccag

SEQ ID NO: 420 - DNA, 174 bp, Artificial sequence
  Synthetic
gtgagtaggcatgatgttctgtgtcttgctaaccacacagtctctgcatgtgaaaagagatgataggatgagcttattaacctcggggtggttcatgcatgtgtcaggctgggggtggagagacagctgtggaacttagtgactcatgacagctatctctgttatcctccacag

SEQ ID NO: 421 - DNA, 97 bp, Artificial sequence
  Synthetic
gtaagtttctgtttccatttcctctcttgtgacacatttcatgactctgcatttacataacccctgactcatggtcttcccactcttgttctctcag

SEQ ID NO: 422 - DNA, 856 bp, Artificial sequence
  Synthetic
gtaagtactgcctatagatataggcgtggctatatactatctatagcatgctatgcattatcttggctttggaccagggcgcttccgcttactcatactatagggtgatggtatagcttaacatataggtggagctattgattgggactgccccctattggtgacggtgtttcctatatctgatcaatactatggccctctgccatgccgcccctcttggcctatagccaatctatcggtgtcggactctgcttagaccccctttccaactcccagagactgacacgcggactctgtttgtttttaaggatggctcttttattcttagaccccacaaacaccgtccggggctaacaggggatctccacggcgatctcgggtacccccggccacgggagtgtggttagtctgtcctcctccggctcctcgggccaggtccccagcagctcttcttgttcttcatcgtcgctgggcacctctcggctgctaattgtcgaggccagactcaggcagatcacgatccccaccactattaccatgccgcccagggccgaggctgtggggtatgcctctaacaacgagcccggggaccctacatgggtccacggactctctgctgtctggagacttaaggccagggaagaagagacagatgatgaagtccctgacagctgagaagaaaaggtaagggagctcgttactcccgtggtgttgtgatagttaacagcggtggagggtagttgtcgctcagtcgtcactgccgccagcagagggagacataagtacaccaggctcaaccacactgtcttcatggatgtttgcaggtagagaccacacgcggcacttcaccagagag

SEQ ID NO: 423 - DNA, 181 bp, Artificial sequence
  Synthetic
gtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacag

SEQ ID NO: 424 - DNA, 213 bp, Artificial sequence
  Synthetic
gtaagtctgttgacatgtatgtgatgtatactaatctgcatgggacgtggatttacttgtgtatgtcagatagagtaaagattaactcttgcatgtgagcggggcatcgagatagcgataaatgagtcaggaggacggatacttatatgtgttgttatcctcctctacagagcctctgctaaccatgttcatgccttcttctttttcctacag

SEQ ID NO: 425 - DNA, 841 bp, Artificial sequence
  Synthetic
gtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagaagcctctgctaaccatgttcatgccttcttctttttcctacag

SEQ ID NO: 426 - DNA, 850 bp, Artificial sequence
  Synthetic
gtaagtactgcctatagatataggcgtggctatatactatctatagcatgctatgcattatcttggctttggaccagggcgcttccgcttactcatactatagggtgatggtatagcttaacatataggtggagctattgattgggactgccccctattggtgacggtgtttcctatatctgatcaatactatggccctctgccatgccgcccctcttggcctatagccaatctatcggtgtcggactctgcttagaccccctttccaactcccagagactgacacgcggactctgtttgtttttaaggatggctcttttattcttagaccccacaaacaccgtccggggctaacaggggatctccacggcgatctcgggtacccccggccacgggagtgtggttagtctgtcctcctccggctcctcgggccaggtccccagcagctcttcttgttcttcatcgtcgctgggcacctctcggctgctaattgtcgaggccagactcaggcagatcacgatccccaccactattaccatgccgcccagggccgaggctgtggggtatgcctctaacaacgagcccggggaccctacatgggtccacggactctctgctgtctggagacttaaggccagggaagaagagacagatgatgaagtccctgacagctgagaagaaaaggtaagggagctcgttactcccgtggtgttgtgatagttaacagcggtggagggcagtgtagtctgagcagtactcgttgctgccgcgcgcgccaccagacataatagctgacagactaacagaagcctctgctaaccatgttcatgccttcttctttttcctacag

SEQ ID NO: 427 - DNA, 181 bp, Artificial sequence; identical to SEQ ID NO: 423
  Synthetic

SEQ ID NO: 428 - DNA, 213 bp, Artificial sequence; identical to SEQ ID NO: 424
  Synthetic

SEQ ID NO: 429 - DNA, 841 bp, Artificial sequence; identical to SEQ ID NO: 425
  Synthetic

SEQ ID NO: 430 - DNA, 850 bp, Artificial sequence; identical to SEQ ID NO: 426
  Synthetic

SEQ ID NO: 431 - DNA, 1133 bp, Artificial sequence
  Synthetic
gtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggcgagaccggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacag

SEQ ID NO: 432 - DNA, 943 bp, Artificial sequence
  Synthetic
gtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaag

SEQ ID NO: 433 - DNA, 923 bp, Artificial sequence
  Synthetic
gtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 434 - DNA, 943 bp, Artificial sequence
  Synthetic
gtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcag

SEQ ID NO: 435 - DNA, 943 bp, Artificial sequence
  Synthetic
gtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 436 - DNA, 938 bp, Artificial sequence
  Synthetic
gtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcag

SEQ ID NO: 437 - DNA, 948 bp, Artificial sequence
  Synthetic
gtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttag

SEQ ID NO: 438 - DNA, 944 bp, Artificial sequence
  Synthetic
gtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaag

SEQ ID NO: 439 - DNA, 994 bp, Artificial sequence
  Synthetic
gtgagtttcgggtgtggcttccgcgggcctggccgccttgccttgagcggattgaggccttcgcacgcctttctgtccagtcgtgctgctgggtcatttttttcgaggttcttggccccgaatttcgggttgcgaggggtgggagagttcgaggcctagcgtttttttcggaagcggcttcgcctcgtgcttgtgttgaggcctggtctgggctcccgggccgtcgcgtgcgaatcccgtcgtacatttgcgccctccccactgccttttctttttttcccttctctttttttttttttacaattgggtgtcgccggctcgttgaacccccaactagcagccgtgattcgatgcctttttccgccgtgcgtggacggggaaccacacgcccgtcggctcgcgcggggcggcggcggctgggcccgcccgtcccggcgcacatgttctgcgcggcctcggggaggcgaggcggggcccgggagccccggccgccagtccgggccggcgtgggcttcgagtagcgggccgagcgacacagctgtccggcctgctttgagcacccatggccgtggctcccggcttggcccggcccgcccggcaccagttgcgtgcgcggaaagatggccgctcccgggcccagttacagggagctcaaaatggaggacgcggcgggccgggagagcgggcgggtgagtcacccacacaaaggaaaagggattttccctcttcggtcgctgtttcctgtgaccctgcagtgctcgggcgccgtcccggcacctcgatgtcgccttggaggctcggcgccctcctgccgggggaggggatttggtcccccggagtttcctctcttggtgggtggagactggtgtgtgaggccagcttggcactggttgtaattctccttggaatttgcccttttgagttgggaccgtggcttattctcaagcctctggatggtggttcacacaaaggtatttttgaacttcctttttag

SEQ ID NO: 440 - DNA, 849 bp, Artificial sequence
  Synthetic
gtgggtgctgggtgttgcttccgtaggcctggcccgggccgggagctggcggtgggcctgccgggcctctctcccgggcagcgcctccagctgccgtgcgggcctcggccccgagcccgaggggcgcggcctttgcctttccagaagcctcggcctcgtgttctggggcgaggcctggcttggcgtccggagcgccgcgtgccggttcgggcgcgctgtggcggctgcctgctgcctgggtatcgagtccaggccttttgggataacaaaggagccccgggtggtagtcgcccgcggagcggagccgctctctatggcaggacctccgcccccggaccgggcgggcccgcgcacaagcctcgtgtcgcttgagcgaggggaggccttggtccgtcgccgggtcggtgggggcagtttggtggcccggcgtcccgtccaacccggggcatcccctagttccgcttcgggcggccttggccgctcggcaccagttgcgtgcgcggaaagatggccgctacgggcctgctccgggagctcaaaatggaggacgcggcggccgggcggtgagtcacccacacaaagagtcggggccttccccgccggccgccgcgtcctgtgacccccgcggcgctctgcccgccattggtcacctgggttactctatgtcgcggtgggggaggggaggcaggcagtgcgttggagtttgctcgcactcggtgggtggagtcgaagtcaggccagcgtggcctcgcatgtcagtcttggagtttgcccctctcggtctggttcgtgacttacttggctcttacagcggttctcagacaattttttttccacttgttgccttag

SEQ ID NO: 441 - DNA, 956 bp, Artificial sequence
  Synthetic
gtgagtgccgggcgtggcttccgcgggcctggcctcccggagcgggctgcggccctcgcgtgcctttctctgctgctgcgccacggagtccctttgcgatgttcttgaccccgaatttcgggtcgtaagtgggtgggagagttcgaggccttgcgcttttttcaggggccccgtcgcctcgtgcttgggtgaaggcctggttggcgcgccgtggctgccgcgtgcgattcccgccgccgcgccgcctcgccggccctgtgatccagaagtctccggccacttgagttctcggggaaagtatccccagtggttttgcgtcgagggggtctgaccgaggttggtcagcgccgacggggcgggcttcgctcgcgtcgcgggctcgggctgtggggcggcggcgggccctccgcccggcgcacatggcctgcgaggcggtgcccgcgagcctcggccccgagtcgacgcgggaggaggcccgtggaggggccaggcggctccggcgccgggctcgcgccgccgtgcgcctccctgccctgggcggcgaggccggcctttgcccgctcggcaccagttgcgtgcgcggaaagatggccgctcgcggccctgtgcagggagctcaaaatggaggacgcggcggcccgggagagcgggcgggtgagtcacccgcacaaagggaaaggcttttccctccacggccgctgcttcctgtgaccccgccgtgtgcccggcaccgtcccggctcctcggtttcatggcctttggagcagggcttcctctggttgggggaggggacttaggcgatggagtttccccacacttggtgggtggagacaagagttgggccagcttggcactggatgattctccttggaatttgccctttgagttttcatcgtggcttgttctcaagcttgtgggacggtggttaaaagatctccccccctccccctctttag

SEQ ID NO: 442 - DNA, 937 bp, Artificial sequence
  Synthetic
gtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaagtttttttcttccatttcag

SEQ ID NO: 443 - DNA, 943 bp, Artificial sequence
  Synthetic
gtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaagtttttttcttccatttcag

SEQ ID NO: 444 - DNA, 928 bp, Artificial sequence
  Synthetic
gtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaagtttttttcttccatttcag

SEQ ID NO: 445 - DNA, 971 bp, Artificial sequence
  Synthetic
gtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcgtcggtcgggctgcaaccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctag

SEQ ID NO: 446 - DNA, 971 bp, Artificial sequence; identical to SEQ ID NO: 445
  Synthetic

SEQ ID NO: 447 - DNA, 963 bp, Artificial sequence
  Synthetic
gtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctag

SEQ ID NO: 448 - DNA, 971 bp, Artificial sequence
  Synthetic
gtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcgtcggtcgggctgcaaccccccctgcacccccctccccgagttgctgagcacggcccggcttcgggtgcggggctccgtacggggcgtggcgcggggctcgccgtgccgggcggggggtggcgccaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctag

SEQ ID NO: 449 - DNA, 956 bp, Artificial sequence
  Synthetic
gtaagcagggacaacaggcccagccggccacagccctcccgtgggcagtgaccgcgctgcagggtcgcgggggacactcggcgcggacaccggggaaggctggagggtggtgccgggccgcggagcggacactttcagatccaactttcagtccagggtgtagaccctttacagccgcattgccacggtgtagacaccggtggacccgctctggctcagagcacgcggcttgggggaacccattagggtcgcagtgtgggcgctatgagagccgatgcagctttcgggtgttgaaccgtatctgcccaccttggggggaggacacaaggtcgggagccaaacgccacgatcatgccttggtggcccatgggtctttgtctaaaccggtttgcccatttggcttgccgggcgggcgggcgcggcgggcccggctcggccgggtgggggctgggttgccactgcgcttgcgcgctctatggctgggtattggggcgcgtgcacgctggggagggagcccttcctcttccccctctcccaagttaaacttgcgcgtgcgtattgagacttggagcgcggccaccggggttgggcgagggcggggccgttgtccggaaggggcggggtcgcagaggattcggggcgcctgctcgcgcttcctgctgggtgtggtcgcctcccgcgcgcgcactagaccgcccggcgggggggcgaaggcgggtcttgcgcccgtttggggagggggcggagacctggcttcctgccgtggggccgcctccggaccagcgtttgcctcttatggtaataacgcggccggcctgggcttcatttgtcccctgagtttgggcgcgcgccccctggcggcccgagaccgcggcttgccggaagtgggcagggcggcaacggctgcgcctagtggcccgccagtgaccgcgaccctcttttgtgccctgatatag

SEQ ID NO: 450 - DNA, 956 bp, Artificial sequence
  Synthetic
gtaagcagggacaacaggcccagccggccacagccctcccgtgggcagtgaccgcgctgcagggtcgcgggggacactcggcgcggacaccggggaaggctggagggtggtgccgggccgcggagcggacactttcagatccaactttcagtccagggtgtagaccctttacagccgcattgccacggtgtagacaccggtggacccgctctggctcagagcacgcggcttgggggaacccattagggtcgcagtgtgggcgctatgagagccgatgcagctttcgggtgttgaaccgtatctgcccaccttggggggaggacacaaggtcgggagccaaacgccacgatcatgccttggtggcccatgggtctttgtctaaaccggtttgcccatttggcttgccgggcgggcgggcgcggcgggcccggctcggccgggtgggggctgggttgccactgcgcttgcgcgctctatggctgggtattggggcgcgtgcacgctggggagggagcccttcctcttccccctctcccaagttaaacttgcgcgtgcgtattgagacttggagcgcggccaccggggttgggcgagggcggggccgttgtccggaaggggcggggtcgcagaggattcggggcgcctgctcgcgcttcctgctgggtgtggtcgcctcccgcgcgcgcactagaccgcccggcgggggggcgaaggcgggtcttgcgcccgtttggggagggggcggacacctggcttcctgccgtggggccgcctccggaccagcgtttgcctcttatggtaataacgcggccggcctgggcttcatttgtcccctgagtttgggcgcgcgccccctggcggcccgtgaccgcggcttgccggaagtgggcagggcggcaacggctgcgcctagtggcccgccagtgaccgcgaccctcttttgtgccctgatatag

SEQ ID NO: 451 - DNA, 959 bp, Artificial sequence
  Synthetic
gtaagcagggacgccgggcccagcgggccttcgctctctcgtggctagtacctcactgcagggtcctgaggatcactcagaacggacaccatgggcgggtggagggtggtgccgggccgcggagcggacactggcacagccaactttacgcctagcgtgtagactctttgcagccacattcccgcggtgtagacactcgtgggcccgctcccgctcggtgcgtggggcttggggacacactagggtcgcggtgtgggcatttgatgagccggtgcggcttgcgggtgttaaaagccgtattaggtccatcttgagagtacacagtattgggaaccagacgctacgatcacgcctcaatggcctctgggtctttgtccaaaccggtttgcctattcggcttgccgggcgggcgggcgggcgggcgggcgcggcagggccggctcggccgggtgggggctgggatgccactgcgcgtgcgctctctatcactgggcatcgaggcgcgtgtgcgctagggagggagctcttcctctccccctcttcctagttagctgcgcgtgcgtattgaggctgggagcgcggctgcccggggttgggcgagggcggggccgttgtccggaaggggcggggtcacagtggcacgggcgccttgtttgcgcttcctgctgggtgtggtcgcctcccgcgcgcgcacaagccgcccgtcggcgcagtgtaggcggagcttgcgcccgtttggggagggggcggaggtctggcttcctgccctaggtccgcctccgggccagcgtttgccttttatggtaataatgcggccggtctgcgcttcctttgtcccctgagcttgggcgcgcgccccctggcggctcgagcccgcggcttgccggaagtgggcagggcggcagcggctgctcttggcggccccgaggtgactatagccttcttttgtgtcttgatag

SEQ ID NO: 452 - DNA, 959 bp, Artificial sequence
  Synthetic
gtaagcagggacgccgggcccagcgggccttcgctctctcgtggctagtacctcactgcagggtcctgaggatcactcagaacggacaccatgggcgggtggagggtggtgccgggccgcggagcggacactggcacagccaactttacgcctagcgtgtagactctttgcagccacattcccgcggtgtagacactcgtgggcccgctcccgctcggtgcgtggggcttggggacacactagggtcgcggtgtgggcatttgatgagccggtgcggcttgcgggtgttaaaagccgtattaggtccatcttgagagtacacagtattgggaaccagacgctacgatcacgcctcaatggcctctgggtctttgtccaaaccggtttgcctattcggcttgccgggcgggcgggcgggcgggcgggcgcggcagggccggctcggccgggtgggggctgggatgccactgcgcgtgcgctctctatcactgggcatcgaggcgcgtgtgcgctagggagggacctcttcctctccccctcttcctagttagctgcgcgtgcgtattgaggctgggagcgcggctgcccggggttgggcgagggcggggccgttgtccggaaggggcggggtcacagtggcacgggcgccttgtttgcgcttcctgctgggtgtggtcgcctcccgcgcgcgcacaagccgcccgtcggcgcagtgtaggcggagcttgcgcccgtttggggagggggcggaggtctggcttcctgccctaggtccgcctccgggccagcgtttgccttttatggtaataatgcggccggtctgcgcttcctttgtcccctgagcttgggcgcgcgccccctggcggctcgagcccgcggcttgccggaagtgggcagggcggcagcggctgctcttggcggccccgaggtgactatagccttcttttgtgtcttgatag

SEQ ID NO: 453 - DNA, 929 bp, Artificial sequence
  Synthetic
gtaagcagggacgtcgggcccagcgggccccaactttaccttggccactacctcgctgcaggatcgtgaggaacactcagaagggacaccgtagaggggtggagcgtggtaccgggccgcggagcagctggcaaagcttaactttcccggcccctagggtgtagagtgtttgcagtcgtattcccgcggtgtggacactcgtgggtacgctcctgcttggtgcgcggggcttggggacacactagagtcgcggtgtgggcatttggagagccggtgcggctgcgggtgttaagccgcatctgtccaccttgaggggcaacagtattggggtcaggcgttacaatcacgctttgatggcctatgggtctttgtccaaaccggttttgccattcggcttggcgggcgcggcggggccgctcggccgggtgggggctgggatgccattgcgcgtgcgcgctctatcactgggcattggggccgtgcgcgctggggagggaactcttcctctccccctcttccgagttaagagttgcgcgtgcgtattgagactaggagcgcggccgccccgggttgggcgagggcgggccgtccaccggaaggggcggggtcgtagcggctaggcgcctgctcgcgcttcctgctgggtgtggtcgcctcccgcgcgcgcactagccgcccgtcgcctcagtgtaggcgggcctgtgcccgtttggggaggggcggaggcctggcttcctgccgtgggtccgcctccgggccagcgtttgccttttatggtaataatgcggctgtcctgcgcttcctttgtcccctgagcttgggcgcgcccctggcggctcgaggccgcggctcgccggaagtgggcagggcggcagcggctgctcttggcggctccgcggtgaccatagccctcttttgtgccttgatag

SEQ ID NO: 454 - DNA, 767 bp, Artificial sequence
  Synthetic
gtaagcccggccagccgaccggggcatgcggccgcggcccttcgcccgtgcagagccgccgtctgggccgcagcggggggcgcatggggcggaaccggaccgccgtggggggcgcgggagaagcccctgggcctccggagatgggggacaccccacgccagttcgcaggcgcgaggccgcgctcgggcgggcgcgctccgggggtgccgctctcggggcgggggcaaccggcggggtctttgtctgagccgggctcttgccaatggggatcgcacggtgggcgcggcgtagcccccgtcaggcccggtgggggctggggcgccatgcgcgtgcgcgctggtcctttgggcgctaactgcgtgcgcgctgggaattggcgctaattgcgcgtgcgcgctgggactcaatggcgctaatcgcgcgtgcgttctggggcccgggcgcttgcgccacttcctgcccgagccgctggcgcccgagggtgtggccgctgcgtgcgcgcgcgcgacccggtcgctgtttgaaccgggcggaggcggggctggcgcccggttgggagggggttggggcctggcttcctgccgcgcgccgcggggacgcctccgaccagtgtttgccttttatggtaataacgcggccggcccggcttcctttgtccccaatctgggcgcgcgccggcgccccctggcggcctaaggactcggcgcgccggaagtggccagggcgggggcgacttcggctcacagcgcgcccggctattctcgcag

SEQ ID NO: 455 - DNA, 1005 bp, Artificial sequence
  Synthetic
gtaagcagggacaacaggcccagccggccacagccctcccgtgggcagtgaccgcgctgcagggtcgcgggggacactcggcgcggacaccggggaaggctggagggtggtgccgggccgcggagcggacactttcagatccaactttcagtccagggtgtagaccctttacagccgcattgccacggtgtagacaccggtggacccgctctggctcagagcacgcggcttgggggaacccattagggtcgcagtgtgggcgctatgagagccgatgcagctttcgggtgttgaaccgtatctgcccaccttggggggaggacacaaggtcgggagccaaacgccacgatcatgccttggtggcccatgggtctttgtctaaaccggtttgcccatttggcttgccgggcgggcgggcgcggcgggcccggctcggccgggtgggggctgggttgccactgcgcttgcgcgctctatggctgggtattggggcgcgtgcacgctggggagggagcccttcctcttccccctctcccaagttaaacttgcgcgtgcgtattgagacttggagcgcggccaccggggttgggcgagggcggggccgttgtccggaaggggcggggtcgcagaggattcggggcgcctgctcgcgcttcctgctgggtgtggtcgcctcccgcgcgcgcactagaccgcccggcgggggggcgaaggcgggtcttgcgcccgtttggggagggggcggacacctggcttcctgccgtggggccgcctccggaccagcgtttgcctcttatggtaataacgcggccggcctgggcttcatttgtcccctgagtttgggcgcgcgccccctggcggcccgtgaccgcggcttgccggaagtgggcagggcggcaacggctgcgcctagtggcccgccagtgaccgcgaccctcttttgtgccctgatatagttcgccagcctctgctaaccatgttcatgccttcttctttttcctacag

SEQ ID NO: 456 - DNA, 1008 bp, Artificial sequence
  Synthetic
gtaagcagggacgccgggcccagcgggccttcgctctctcgtggctagtacctcactgcagggtcctgaggatcactcagaacggacaccatgggcgggtggagggtggtgccgggccgcggagcggacactggcacagccaactttacgcctagcgtgtagactctttgcagccacattcccgcggtgtagacactcgtgggcccgctcccgctcggtgcgtggggcttggggacacactagggtcgcggtgtgggcatttgatgagccggtgcggcttgcgggtgttaaaagccgtattaggtccatcttgagagtacacagtattgggaaccagacgctacgatcacgcctcaatggcctctgggtctttgtccaaaccggtttgcctattcggcttgccgggcgggcgggcgggcgggcgggcgcggcagggccggctcggccgggtgggggctgggatgccactgcgcgtgcgctctctatcactgggcatcgaggcgcgtgtgcgctagggagggacctcttcctctccccctcttcctagttagctgcgcgtgcgtattgaggctgggagcgcggctgcccggggttgggcgagggcggggccgttgtccggaaggggcggggtcacagtggcacgggcgccttgtttgcgcttcctgctgggtgtggtcgcctcccgcgcgcgcacaagccgcccgtcggcgcagtgtaggcggagcttgcgcccgtttggggagggggcggaggtctggcttcctgccctaggtccgcctccgggccagcgtttgccttttatggtaataatgcggccggtctgcgcttcctttgtcccctgagcttgggcgcgcgccccctggcggctcgagcccgcggcttgccggaagtgggcagggcggcagcggctgctcttggcggccccgaggtgactatagccttcttttgtgtcttgatagttcgccagcctctgctaaccatgttcatgccttcttctttttcctacag

SEQ ID NO: 457 - DNA, 978 bp, Artificial sequence
  Synthetic
gtaagcagggacgtcgggcccagcgggccccaactttaccttggccactacctcgctgcaggatcgtgaggaacactcagaagggacaccgtagaggggtggagcgtggtaccgggccgcggagcagctggcaaagcttaactttcccggcccctagggtgtagagtgtttgcagtcgtattcccgcggtgtggacactcgtgggtacgctcctgcttggtgcgcggggcttggggacacactagagtcgcggtgtgggcatttggagagccggtgcggctgcgggtgttaagccgcatctgtccaccttgaggggcaacagtattggggtcaggcgttacaatcacgctttgatggcctatgggtctttgtccaaaccggttttgccattcggcttggcgggcgcggcggggccgctcggccgggtgggggctgggatgccattgcgcgtgcgcgctctatcactgggcattggggccgtgcgcgctggggagggaactcttcctctccccctcttccgagttaagagttgcgcgtgcgtattgagactaggagcgcggccgccccgggttgggcgagggcgggccgtccaccggaaggggcggggtcgtagcggctaggcgcctgctcgcgcttcctgctgggtgtggtcgcctcccgcgcgcgcactagccgcccgtcgcctcagtgtaggcgggcctgtgcccgtttggggaggggcggaggcctggcttcctgccgtgggtccgcctccgggccagcgtttgccttttatggtaataatgcggctgtcctgcgcttcctttgtcccctgagcttgggcgcgcccctggcggctcgaggccgcggctcgccggaagtgggcagggcggcagcggctgctcttggcggctccgcggtgaccatagccctcttttgtgccttgatagttcgccagcctctgctaaccatgttcatgccttcttctttttcctacag

SEQ ID NO: 458 - DNA, 833 bp, Artificial sequence
  Synthetic
gtaagcccggccagccgaccggggcatgcggccgcggcccttcgcccgtgcagagccgccgtctgggccgcagcggggggcgcatggggcggaaccggaccgccgtggggggcgcgggagaagcccctgggcctccggagatgggggacaccccacgccagttcgcaggcgcgaggccgcgctcgggcgggcgcgctccgggggtgccgctctcggggcgggggcaaccggcggggtctttgtctgagccgggctcttgccaatggggatcgcacggtgggcgcggcgtagcccccgtcaggcccggtgggggctggggcgccatgcgcgtgcgcgctggtcctttgggcgctaactgcgtgcgcgctgggaattggcgctaattgcgcgtgcgcgctgggactcaatggcgctaatcgcgcgtgcgttctggggcccgggcgcttgcgccacttcctgcccgagccgctggcgcccgagggtgtggccgctgcgtgcgcgcgcgcgacccggtcgctgtttgaaccgggcggaggcggggctggcgcccggttgggagggggttggggcctggcttcctgccgcgcgccgcggggacgcctccgaccagtgtttgccttttatggtaataacgcggccggcccggcttcctttgtccccaatctgggcgcgcgccggcgccccctggcggcctaaggactcggcgcgccggaagtggccagggcggcagcggctgctcttggcggccccgaggtgactatagccttcttttgtgtcttgatagttcgccagcctctgctaaccatgttcatgccttcttctttttcctacag

SEQ ID NO: 459 - DNA, 240 bp, Artificial sequence
  Synthetic
gtaaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcag

SEQ ID NO: 460 - DNA, 240 bp, Artificial sequence
  Synthetic
gtgaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcag

SEQ ID NO: 461 - DNA, 240 bp, Artificial sequence
  Synthetic
gtgaaaatcgcggagtgggccgcaggaggccggggacagtcggaaactgggaaggggagtgggcactgtacgggtctagggatgctggtgcgaagtgtgcaagccggacccaggctccgcattgcaggggggggatgatggaggacgtgatggggcgcacggcgggaatggaggcggggtgggggaggggactgcctggtgtccttcgggccacgctaatctcattttcttctcctgcag

SEQ ID NO: 462 - DNA, 188 bp, Artificial sequence
  Synthetic
gtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccag

SEQ ID NO: 463 - DNA, 193 bp, Artificial sequence
  Synthetic
gtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccag

SEQ ID NO: 464 - DNA, 1018 bp, Artificial sequence
  Synthetic
gtgagtgaccccggagcggcggtgctcggggccggagacggtacctcggggctgcgggacgtgtcggtggcggtccgcggaggccggcctgggaggagacatggctgccggggcggcgggacgtggacggacggggcggctggcgccatgtctgcgcgtcgggctgtggcctcggcacggcggccgttgtcccctcggcggacggtgctgatttggcagtgggcacagccaggcctctggccgccctcgggcgtgggatcgctggtcccgtccccggcggagggccagcgtccctttacgaggtgacagccgggtgggcggtcttccgtttgcacatccgcgtcccctgtggccggcctccgcgcgtcacgtcgctgctgtaggaccccctcctgaacggtgacgtgctccctgctaaccaaatggattccgaaggtagcctgggcaagggctctcgcatcccgccatgtggaacccgctggctttgggtggcgcaaagcgtgtcccatgccgagcgtctggaggttctgtgcctccacacgtgtggacccatcgagttgtcatgagtagtgtcctgctgaggttcccacgcacttctaggcactgcttgcttggctgtgaagctggggtggcaggcgcagttttgttgcctgtggatgcgttggaagattgggggcctttggttattgcggtggtgactgtctttgagatagggtttcacgtagcccaggcttgctcaggtggttagttcagggtttgtttagttagggctggacttctgacgtgctggctgtggactcttgatctgtatgctaacgaggtgcttgggcttgcaggctcgagtcaccgcggactcactgttccttatgaatgacaaccgaggctccatcttgggctgacggtcgtggttgtagtggctgtgtgcgcactggagtgttgtgtgggcaggccacggccacgcgtgggaaacgacatgctgctgcctgcagtttgctcagctgcccctcccccatcccag

SEQ ID NO: 465 - DNA, 1018 bp, Artificial sequence
  Synthetic
gtgagtgaccccggagcggcggtgctcggggccggagtcggtacctcggggctgcgggacgtgtcggtggcggtccgcggaggccggcctgggaggagacatggctgccggggcggcgggacgtggacggacggggcggctggcgccatgtctgcgcgtcgggctgtggcctcggcacggcggccgttgtcccctcggcggacggtgctgatttggcagtgggcacagccaggcctctggccgccctcgggcgtgggatcgctggtcccgtccccggcggagggccagcgtccctttacgaggtgacagccgggtgggcggacttccgtttgcacatccgcgtcccctgtggccggcctccgcgcgtcacgtcgctgctgtaggaccccctcctgaacggtgacgtgctccctgctaaccaaatggattccgaaggtagcctgggcaagggctctcgcatcccgccatgtggaacccgctggctttgggtggcgcaaagcgtgtcccatgccgagcgtctggaggttctgtgcctccacacgtgtggacccatcgagttgtcatgagtagtgtcctgctgaggttcccacgcacttctaggcactgcttgcttggctgtgaagctggggtggcaggcgcagttttgttgcctgtggatgcgttggaagattgggggcctttggttattgcggtggtgactgtctttgagatagggtttcacgtagcccaggcttgctcaggtggttagttcagggtttgtttagttagggctggacttctgacgtgctggctgtggactcttgatctgtatgctaacgaggtgcttgggcttgcaggctcgagtcaccgcggactcactgttccttatgaatgacaaccgaggctccatcttgggctgacggtcgtggttgtagtggctgtgtgcgcactggagtgttgtgtgggcaggccacggccacgcgtgggaaacgacatgctgctgcctgcagtttgctcagctgcccctcccccatcccag

SEQ ID NO: 466 - DNA, 1028 bp, Artificial sequence
  Synthetic
gtgagtaaccctgcctcgctggtgccccggagcggcggcggggcctccgcggggcctacgctgcctagcctgggacgctggggccccccgtgccaggaggagacgtagcggcggcggggccggaggacccggggctggggaagcggccgccgccatgtctgtgcgccgcgctgttcaccgagccctttctccgtttccgagggcgccataaccttgcccagacctggttggagctgggttgttagcggggatgggggtggggaatgatgatgtggcaggcgtagtaatggcgggcaccgcggtggaagcggggagacagggaggcgccttatgtaacccgcgggccgcgagtttgagatcgattttctgccgggggactaggggcggcagggaaatggcagaacgagcaaagcgacacctgaaaggctccccttttccttccaaataccttctcctgatgctgttaatcgtcgaccttaggcacttgtccttcctatgactcccagatgtacaaagactcttattgagacacgaggtgtaggcttgtggcagttagggccgttccggctccccgttatttcctggggtgggtggccttgtctgatcccgtttgccaaggggtgaccttgcattttatgatgaagcttcttgctcggggaagtttgggtggcccggtgacaacgtggagggggctttaggagaggattcatcccttacgtgtttggccccaaatgagactttagtatttgtacctggtatcaaggaaatctgttgacactcagttttattcctgagcacttttatttctgggttgtcaatcatgaatgacacctattaacggtggttccttggagattgcggggtggctcttaaggggtgttaggctggcaagattcggtgggcttggggcaccccagcaccaaccccctcctggccttgggcatgctggttcgtttggactgaacgctccgtgccatgctgtgttcctggaaatcacgagctggtctgagcctccttgtcttgcccag

SEQ ID NO: 467 - DNA, 1027 bp, Artificial sequence
  Synthetic
gtgagtaaccctgcctcgctggtgccccggagcggcggcggggcctccgcggggcctacgctgcctagcctgggacgctggggccccccgtgccaggaggagaggtagcggcggcggggccggaggacccggggctggggaagcggccgccgccatgtctgtgcgccgcgctgttcaccgagccctttctccgtttccgagggcgccataaccttgcccagacctggttggagctgggttgttagcggggatgggggtggggaatgatgatgtggcaggcgtagtaatggcgggcaccgcggtggaagcggggagacagggaggcgccttatgtaacccgcgggccgcgagtttgagatcgattttctgccgggggactaggggcggcagggaatggcagaacgagcaaagcgacacctgaaaggctccccttttccttccaaataccttctcctgatgctgttaatcgtcgaccttaggcacttgtccttcctatgactcccagatgtacaaagactcttattgagacacgaggtgtaggcttgtggcagttagggccgttccggctccccgttatttcctggggtgggtggccttgtctgatcccgtttgccaaggggtgaccttgcattttatgatgaagcttcttgctcggggaagtttgggtggcccggtgacaacgtggagggggctttaggagaggattcatcccttacgtgtttggccccaaatgagactttagtatttgtacctggtatcaaggaaatctgttgacactcagttttattcctgagcacttttatttctgggttgtcaatcatgaatgacacctattaacggtggttccttggagattgcggggtggctcttaaggggtgttaggctggcaagattcggtgggcttggggcaccccagcaccaaccccctcctggccttgggcatgctggttcgtttggactgaacgctccgtgccatgctgtgttcctggaaatcacgagctggtctgagcctccttgtcttgcccag

SEQ ID NO: 468 - DNA, 935 bp, Artificial sequence
  Synthetic
gtgagtctcctcggctccgctagactcggggaccgagacgaatctctggggcagcgggacgtggctgtagcgggacgctgagagggacgggaggaagagacatggctgccctggcccgggcggcaggacgtggtcgggccgcggcgccatatctgcgcgtccctgagggccttgggagtgtcaactgccgaggtcggggtgttttcttgaagtccttcaactccccgcggccgccggggtgactgcgggaggggttgtgcttggtgatgtggcagcgggcaaagcgccgtccccgcgcccctggtgacgggcggagggtgtcctcgggaggtgacagcctgtagggctggcttccttggacacctccagtgggctgaacgccttccgggccctttccggtagcccccgtctctgttttctatctgagttcacacgtgagcaccggtccccataatctaagaaagtggctcactgggcctagtggcgcattgtggcctttgatccgggctttgaccttggcgcacagcacccagtggtttggggaagaggtgtgtgtagcagaggaggttttttcgtgctttggtcccaatcaatccggcatctttgcagtgccgaggtggccgtgcaccttggctttgaattcttgtgctgaggttatgtgacttgagcctcaagatagggtcttctagcacaggcttgctcttaagtgtcgcagttgtcggtttcggcgtttgtttagagctgtggacacatctgtgaacttttgatgcttatttcagaggtcctgggttgtacgtttgagtcacactgtgagctcagctccaatcttgggccgacatctggttcctgcccctgctgtggggtgctattgacccaccgatgcctgccaagttgggttcccagaatcagcctggctgcccatccccccaccacag

SEQ ID NO: 469 - DNA, 935 bp, Artificial sequence
  Synthetic
gtgagtctcctcggctccgctagactcggggaccgagaggaatctctggggcagcgggacgtggctgtagcgggacgctgagagggacgggaggaagagacatggctgccctggcccgggcggcaggacgtggtcgggccgcggcgccatatctgcgcgtccctgagggccttgggagtgtcaactgccgaggtcggggtgttttcttgaagtccttcaactccccgcggccgccggggtgactgcgggaggggttgtgcttggtgatgtggcagcgggcaaagcgccgtccccgcgcccctggtgacgggcggagggtgtcctcgggaggtgacagcctgtagggctggcttccttggacacctccagtgggctgaacgccttccgggccctttccggtagcccccgtgtctgttttctatctgagttcacacgtgagcaccggtccccataatctaagaaagtggctcactgggcctagtggcgcattgtggcctttgatccgggctttgaccttggcgcacagcacccagtggtttggggaagaggtgtgtgtagcagaggaggttttttcgtgctttggtcccaatcaatccggcatctttgcagtgccgaggtggccgtgcaccttggctttgaattcttgtgctgaggttatgtgacttgagcctcaagatagggtgttctagcacaggcttgctcttaagtgtcgcagttgtcggtttcggcgtttgtttagagctgtggacacatctgtgaacttttgatgcttatttcagaggtcctgggttgtacgtttgagtcacactgtgagctcagctccaatcttgggccgacatctggttcctgcccctgctgtggggtgctattgacccaccgatgcctgccaagttgggttcccagaatcagcctggctgcccatccccccaccacag

SEQ ID NO: 470 - DNA, 874 bp, Artificial sequence
  Synthetic
gtgagtgtccgcggcgcggcaagacttggggactgagacgagtcttcggggcagcgggaggtggccggagcgggacccggaaaagaaaggagacatggctgcctctgcatgggtggcgggacgtggtcggctcgcggcgccatatctgcacctcctctgcccgtctttgggagtgtcggcctcctgaagttggagtgttttctctaattccttcgtccagctctcctttccgagaacgctggggtggctgtgggaggggcggcgtttgctgatgtggcagcggacataatgctgtatagccctgtgcccatggtgacagggtgatggtgctcccgggaagtgacagcctgcaggggtggctcacatggagacctctagtgagctgagcgtcttccgccctggcctttatctccttccttggtccgcacaatggaaccggtcccctccaagctgagaaaatggctcatgggcctaggggcctattgtggcctttgatcccagcatttgaccttggcgcacaaggcgggttggcagtgtgtagcaggcgaggttttgtcggcctgtgtgggccccatctcgtgcgggccccctgtcgcctgcattgttggactgctggggtggcagtccagcttggcgttgattacgtggtgcggtctcagcctaggctccctggtactcttgttctagttgtcattttggttagggttgggttcctgacacatctggtgactcttgatgcttcttaggtggtaggcttgtaggtgtgagtcgaatgagcgccagttttggggagacagctctttggaaccccacaatggggtgctatcgacccgagttcccagaatcagtcctgaccgcccttcccccaccacag

SEQ ID NO: 471 - DNA, 874 bp, Artificial sequence
  Synthetic
gtgagtgtccgcggcgcggcaagacttggggactgtgacgagacttcggggcagcgggaggtggccggagcgggacccggaaaagaaaggagacatggctgcctctgcatgggtggcgggacgtggtcggctcgcggcgccatatctgcacctcctctgcccgtctttgggagtgtcggcctcctgaagttggagtgttttctctaattccttcgtccagctctcctttccgagaacgctggggtggctgtgggaggggcggcgtttgctgatgtggcagcggacataatgctgtatagccctgtgcccatggtgacagggtgatggtgctcccgggaagtgacagcctgcaggggtggctcacatggtgacctctagtgagctgagcctcttccgccctggcctttatctccttccttggtccgcacaatggaaccggtcccctccaagctgagaaaatggctcatgggcctaggggcctattgtggcctttgatcccagcatttgaccttggcgcacaaggcgggttggcagtgtgtagcaggcgaggttttgtcggcctgtgtgggccccatctcgtgcgggccccctgtcgcctgcattgttggactgctggggtggcagtccagcttggcgttgattacgtggtgcggtcacagcctaggctccctggtactcttgttctagttgtcattttggttagggttgggttcctgacacatctggtgactcttgatgcttcttaggtggtaggcttgtaggtgtgagtcgaatgagcgccagttttggggagacagctctttggaaccccacaatggggtgctatcgacccgagttcccagaatcagtcctgaccgcccttcccccaccacag

SEQ ID NO: 472 - DNA, 66 bp, Artificial sequence
  Synthetic
gtaaatataaaatttttaagtgtataatgtgttaaactactgattctaattgtttgtgtattttag

SEQ ID NO: 473 - DNA, 530 bp, Artificial sequence
  Synthetic
ttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtattactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccg

SEQ ID NO: 474 - DNA, 1388 bp, Artificial sequence
  Synthetic
ttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtattactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccgtcacttcgcttggagccaccgtccacgctgtttggagctccatagaaggaaccgggacccagccagcctccgtagccgggaacggtgcattggaacgcggatacagcgtgccaatagtgacgtaagtactgcctatagatataggcgtggctatatactatctatagcatgctatgcattatcttggctttggaccagggcgcttccgcttactcatactatagggtgatggtatagcttaacatataggtggagctattgattgggactgccccctattggtgacggtgtttcctatatctgatcaatactatggccctctgccatgccgcccctcttggcctatagccaatctatcggtgtcggactctgcttagaccccctttccaactcccagagactgacacgcggactctgtttgtttttaaggatggctcttttattcttagaccccacaaacaccgtccggggctaacaggggatctccacggcgatctcgggtacccccggccacgggagtgtggttagtctgtcctcctccggctcctcgggccaggtccccagcagctcttcttgttcttcatcgtcgctgggcacctctcggctgctaattgtcgaggccagactcaggcagatcacgatccccaccactattaccatgccgcccagggccgaggctgtggggtatgcctctaacaacgagcccggggaccctacatgggtccacggactctctgctgtctggagacttaaggccagggaagaagagacagatgatgaagtccctgacagctgagaagaaaaggtaagggagctcgttactcccgtggtgttgtgatagttaacagcggtggaggg

SEQ ID NO: 475 - DNA, 1501 bp, Artificial sequence
  Synthetic
ttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtattactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccgtcacttcgcttggagccaccgtccacgctgtttggagctccatagaaggaaccgggacccagccagcctccgtagccgggaacggtgcattggaacgcggatacagcgtgccaatagtgacgtaagtactgcctatagatataggcgtggctatatactatctatagcatgctatgcattatcttggctttggaccagggcgcttccgcttactcatactatagggtgatggtatagcttaacatataggtggagctattgattgggactgccccctattggtgacggtgtttcctatatctgatcaatactatggccctctgccatgccgcccctcttggcctatagccaatctatcggtgtcggactctgcttagaccccctttccaactcccagagactgacacgcggactctgtttgtttttaaggatggctcttttattcttagaccccacaaacaccgtccggggctaacaggggatctccacggcgatctcgggtacccccggccacgggagtgtggttagtctgtcctcctccggctcctcgggccaggtccccagcagctcttcttgttcttcatcgtcgctgggcacctctcggctgctaattgtcgaggccagactcaggcagatcacgatccccaccactattaccatgccgcccagggccgaggctgtggggtatgcctctaacaacgagcccggggaccctacatgggtccacggactctctgctgtctggagacttaaggccagggaagaagagacagatgatgaagtccctgacagctgagaagaaaaggtaagggagctcgttactcccgtggtgttgtgatagttaacagcggtggagggcagtgtagtctgagcagtactcgttgctgccgcgcgcgccaccagacataatagctgacagactaacagaagcctctgctaaccatgttcatgccttcttctttttcctacag

SEQ ID NO: 476 - DNA, 1507 bp, Artificial sequence
  Synthetic
ttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtattactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccgtcacttcgcttggagccaccgtccacgctgtttggagctccatagaaggaaccgggacccagccagcctccgtagccgggaacggtgcattggaacgcggatacagcgtgccaatagtgacgtaagtactgcctatagatataggcgtggctatatactatctatagcatgctatgcattatcttggctttggaccagggcgcttccgcttactcatactatagggtgatggtatagcttaacatataggtggagctattgattgggactgccccctattggtgacggtgtttcctatatctgatcaatactatggccctctgccatgccgcccctcttggcctatagccaatctatcggtgtcggactctgcttagaccccctttccaactcccagagactgacacgcggactctgtttgtttttaaggatggctcttttattcttagaccccacaaacaccgtccggggctaacaggggatctccacggcgatctcgggtacccccggccacgggagtgtggttagtctgtcctcctccggctcctcgggccaggtccccagcagctcttcttgttcttcatcgtcgctgggcacctctcggctgctaattgtcgaggccagactcaggcagatcacgatccccaccactattaccatgccgcccagggccgaggctgtggggtatgcctctaacaacgagcccggggaccctacatgggtccacggactctctgctgtctggagacttaaggccagggaagaagagacagatgatgaagtccctgacagctgagaagaaaaggtaagggagctcgttactcccgtggtgttgtgatagttaacagcggtggagggtagttgtcgctcagtcgtcactgccgccagcagagggagacataagtacaccaggctcaaccacactgtcttcatggatgtttgcaggtagagaccacacgcggcacttcaccagagag

SEQ ID NO: 477 - DNA, 833 bp, Artificial sequence
  Synthetic
ttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtattactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccgtcacttcgcttggagccaccgtccacgctgtttggagctccatagaaggaaccgggaacctgaagtcctttgaagatatcaccaaggagtgtgataagaaccccgggaaggacattctgcaagaacttggtgagtaggcatgatgttctgtgtcttgctaaccacacagtctctgcatgtgaaaagagatgataggatgagcttattaacctcggggtggttcatgcatgtgtcaggctgggggtggagagacagctgtggaacttagtgactcatgacagctatctctgttatcctccacag

SEQ ID NO: 478 - DNA, 846 bp, Artificial sequence
  Synthetic
ttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtattactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccgtcacttcgcttggagccaccgtccacgctgtttggagctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacag

SEQ ID NO: 479 - DNA, 1011 bp, Artificial sequence
  Synthetic
ccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggtagcttccttcttctttttcctagaagctcagaataaacgctcaactttggccgccacc

SEQ ID NO: 480 - DNA, 1021 bp, Artificial sequence
  Synthetic
ccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaatttcaccgtccttgacacgaagtttgctgccgccacc

SEQ ID NO: 481 - DNA, 1581 bp, Artificial sequence
  Synthetic
ggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagaagcctctgctaaccatgttcatgccttcttctttttcctacagctcctgggcaacgtgctggttattgtgctgtctcatcattttggcaaagaattccgtctcaggggacagaccaccaataattcaaagcaagccgccacc

SEQ ID NO: 482 - DNA, 1560 bp, Artificial sequence
  Synthetic
ggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagaagcctctgctaaccatgttcatgccttcttctttttcctacagctcctgggcaacgtgctggtagcttccttcttctttttcctagaagctcagaataaacgctcaactttggccgccacc

SEQ ID NO: 483 - DNA, 1021 bp, Artificial sequence
  Synthetic
ccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagactccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaatttcaccgtccttgacacgaagtttgctgccgccacc

SEQ ID NO: 484 - DNA, 1582 bp, Artificial sequence
  Synthetic
ccaacattaccgccatgttgacttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtattactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccgtcacttcgcttggagccaccgtccacgctgtttggagctccatagaaggaaccgggacccagccagcctccgtagccgggaacggtgcattggaacgcggatacagcgtgccaatagtgacgtaagtactgcctatagatataggcgtggctatatactatctatagcatgctatgcattatcttggctttggaccagggcgcttccgcttactcatactatagggtgatggtatagcttaacatataggtggagctattgattgggactgccccctattggtgacggtgtttcctatatctgatcaatactatggccctctgccatgccgcccctcttggcctatagccaatctatcggtgtcggactctgcttagaccccctttccaactcccagagactgacacgcggactctgtttgtttttaaggatggctcttttattcttagaccccacaaacaccgtccggggctaacaggggatctccacggcgatctcgggtacccccggccacgggagtgtggttagtctgtcctcctccggctcctcgggccaggtccccagcagctcttcttgttcttcatcgtcgctgggcacctctcggctgctaattgtcgaggccagactcaggcagatcacgatccccaccactattaccatgccgcccagggccgaggctgtggggtatgcctctaacaacgagcccggggaccctacatgggtccacggactctctgctgtctggagacttaaggccagggaagaagagacagatgatgaagtccctgacagctgagaagaaaaggtaagggagctcgttactcccgtggtgttgtgatagttaacagcggtggagggcagtgtagtctgagcagtactcgttgctgccgcgcgcgccaccagacataatagctgacagactaacagaagcctctgctaaccatgttcatgccttcttctttttcctacagctcctgggcaacgtgctggttattgtgctgtctcatcattttggcaaagaattgccacc

SEQ ID NO: 485 - DNA, 1669 bp, Artificial sequence
  Synthetic
ccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagactccattcacttcgcttggagccaccgtccacgctgtttggagctccatagaaggaaccgggacccagccagcctccgtagccgggaacggtgcattggaacgcggatacagcgtgccaatagtgacgtaagtactgcctatagatataggcgtggctatatactatctatagcatgctatgcattatcttggctttggaccagggcgcttccgcttactcatactatagggtgatggtatagcttaacatataggtggagctattgattgggactgccccctattggtgacggtgtttcctatatctgatcaatactatggccctctgccatgccgcccctcttggcctatagccaatctatcggtgtcggactctgcttagaccccctttccaactcccagagactgacacgcggactctgtttgtttttaaggatggctcttttattcttagaccccacaaacaccgtccggggctaacaggggatctccacggcgatctcgggtacccccggccacgggagtgtggttagtctgtcctcctccggctcctcgggccaggtccccagcagctcttcttgttcttcatcgtcgctgggcacctctcggctgctaattgtcgaggccagactcaggcagatcacgatccccaccactattaccatgccgcccagggccgaggctgtggggtatgcctctaacaacgagcccggggaccctacatgggtccacggactctctgctgtctggagacttaaggccagggaagaagagacagatgatgaagtccctgacagctgagaagaaaaggtaagggagctcgttactcccgtggtgttgtgatagttaacagcggtggagggcagtgtagtctgagcagtactcgttgctgccgcgcgcgccaccagacataatagctgacagactaacagaagcctctgctaaccatgttcatgccttcttctttttcctacagctcctgggcaacgtgctggttattgtgctgtctcatcattttggcaaagaattgccacc

SEQ ID NO: 486 - DNA, 1088 bp, Artificial sequence
  Synthetic
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcctcactcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagactgcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccagcgtctcaggggacacccaagctgtctagagccgccacc

SEQ ID NO: 487 - DNA, 878 bp, Artificial sequence
  Synthetic
ccaacattaccgccatgttgacttcaatgtctatatatggagatccgcatattgacgtcaatatcggtaaatggcccacttggctgaccgccccacgacccccgcccattgacgtcaatggtgggactttccattgacgtcaatgggcggggaacggatatgagccatagaatgtactgccaagtgggccatttaccgttcaccacgcccctattgacgtcaatgacggtaaatggcccgcctggctgtacgccaattgcatcatcctattgtttttctatgggaatttccctattggcagtacatcaacgtattactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccgtcacttcgcttggagccaccgtccacgctgtttggagctccatagaaggaaccgggaacctgaagtcctttgaagatatcaccaaggagtgtgataagaaccccgggaaggacattctgcaagaacttggtgagtaggcatgatgttctgtgtcttgctaaccacacagtctctgcatgtgaaaagagatgataggatgagcttattaacctcggggtggttcatgcatgtgtcaggctgggggtggagagacagctgtggaacttagtgactcatgacagctatctctgttatcctccacagttaagcagattaaggccgccacc

SEQ ID NO: 488 - DNA, 930 bp, Artificial sequence
  Synthetic
ccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagactccatagctccatagaaggaaccgggaacctgaagtcctttgaagatatcaccaaggagtgtgataagaaccccgggaaggacattctgcaagaacttggtgagtaggcatgatgttctgtgtcttgctaaccacacagtctctgcatgtgaaaagagatgataggatgagcttattaacctcggggtggttcatgcatgtgtcaggctgggggtggagagacagctgtggaacttagtgactcatgacagctatctctgttatcctccacagttaagcagattaaggccgccacc

SEQ ID NO: 489 - DNA, 895 bp, Artificial sequence
  Synthetic
gaattcgtttatcggccaccgaggccaagatctggccgccaattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagactccatatcgccgatcaggcatccgtcaacgcccacggccgtcacttggataagaaccgtgtctacccatcagacaagtaagtttctgtttccatttcctctcttgtgacacatttcatgactctgcatttacataacccctgactcatggtcttcccactcttgttctctcagggtgccagctcagcttccttcttctttttcctagaagctcagaataaacgctcaactttggccgccacc

SEQ ID NO: 490 - DNA, 623 bp, Artificial sequence
  Synthetic
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcgtctcaggggacacccaagctgtctagagccgccacc

SEQ ID NO: 491 - DNA, 1695 bp, Artificial sequence
  Synthetic
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcgtcggtcgggctgcaaccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattcggcttgatcgaagccgtctcaggggacacccaagctgtctagagccgccacc

SEQ ID NO: 492 - DNA, 870 bp, Artificial sequence
  Synthetic
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagcgtctcaggggacacccaagctgtctagagccgccacc

SEQ ID NO: 493 - DNA, 1937 bp, Artificial sequence
  Synthetic
actacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcaggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcgtcggtcgggctgcaaccccccctgcacccccctccccgagttgctgagcacggcccggcttcgggtgcggggctccgtacggggcgtggcgcggggctcgccgtgccgggcggggggtggcgccaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattcggcttgatcgaagccgtctcaggggacacccaagctgtctagagccgccacc

SEQ ID NO: 494 - DNA, 1516 bp, Artificial sequence
  Synthetic
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttgacacgcgtctcaggggacacccaagctgtctagagccgccacc

SEQ ID NO: 495 - DNA, 1516 bp, Artificial sequence; identical to SEQ ID NO: 494
  Synthetic

SEQ ID NO: 496 - DNA, 1133 bp, Artificial sequence
  Synthetic
actacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccaggtaaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcagccgagccacatcgctccgtctcaggggacacccaagctgtctagagccgccacc

SEQ ID NO: 497 - DNA, 534 bp, Artificial sequence
  Synthetic
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagcgtctcaggggacacccaagctgtctagagccgccacc

SEQ ID NO: 498 - DNA, 1516 bp, Artificial sequence; identical to SEQ ID NO: 494
  Synthetic

SEQ ID NO: 499 - DNA, 878 bp, Artificial sequence
  Synthetic
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggacacccaagctgtctagagccgccacc

SEQ ID NO: 500 - DNA, 1489 bp, Artificial sequence
  Synthetic
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggacacccaagctgtctagagccgccacc

SEQ ID NO: 501 - DNA, 1516 bp, Artificial sequence; identical to SEQ ID NO: 494
  Synthetic

SEQ ID NO: 502 - DNA, 1516 bp, Artificial sequence; identical to SEQ ID NO: 494
  Synthetic

SEQ ID NO: 503 - DNA, 558 bp, Artificial sequence
  Synthetic
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatccgtctcaggggacacccaagctgtctagagccgccacc

SEQ ID NO: 504 - DNA, 1133 bp, Artificial sequence; identical to SEQ ID NO: 496
  Synthetic

SEQ ID NO: 505 - DNA, 361 bp, Artificial sequence
  Synthetic
ggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatcgctgactaattttttttatttatgcagaggccgaggccgcctcggcctctgagctattccagaagtagtgaggaggcttttttggaggcctaggcttttgcaaaaagcttcgtctcaggggacacccaagctgtctagagccgccacc

SEQ ID NO: 506 - DNA, 1469 bp, Artificial sequence
  Synthetic
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcctgaacacgtctcaggggacacccaagctgtctagagccgccacc

SEQ ID NO: 507 - DNA, 1062 bp, Artificial sequence
  Synthetic
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggggacacccaagctgtctagagccgccacc

SEQ ID NO: 508 - DNA, 1516 bp, Artificial sequence; identical to SEQ ID NO: 494
  Synthetic

SEQ ID NO: 509 - DNA, 1062 bp, Artificial sequence; identical to SEQ ID NO: 507
  Synthetic

SEQ ID NO: 510 - DNA, 1080 bp, Artificial sequence
  Synthetic
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaaggggacacccaagctgtctagagccgccacc

SEQ ID NO: 511 - DNA, 1043 bp, Artificial sequence
  Synthetic
caacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagcgtctcaggggctctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagagggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggggacacccaagctgtctagagccgccacc

SEQ ID NO: 512 - DNA, 1076 bp, Artificial sequence
  Synthetic
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggcggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggggacacccaagctgtctagagccgccacc

SEQ ID NO: 513 - DNA, 1080 bp, Artificial sequence; identical to SEQ ID NO: 510
  Synthetic

SEQ ID NO: 514 - DNA, 1043 bp, Artificial sequence; identical to SEQ ID NO: 511
  Synthetic

SEQ ID NO: 515 - DNA, 697 bp, Artificial sequence
  Synthetic
attgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctgtagacgccatccacgctgttttgacctccatagaagacaccgggaccgatccagcctccggggacacccaagctgtctagagccgccacc

SEQ ID NO: 516 - DNA, 1670 bp, Artificial sequence
  Synthetic
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcctgaacacgtctcaggggacacccaagctgtctagagccgccacc

SEQ ID NO: 517 - DNA, 1469 bp, Artificial sequence; identical to SEQ ID NO: 506
  Synthetic

SEQ ID NO: 518 - DNA, 1311 bp, Artificial sequence
  Synthetic
gagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacatacataaggtcaataggggtgactagtaaatcaacgggaccgaagaacaacgaggagaagatcctcaacttttccgcagccttttcaataatggggagaggttcgatgatgcagtggcagggtgacccacacttctccatttcccctgttctcccattttactcgggaagcagcattcaggtttctgggtcctggatgtccttggtgcacactccaaggactcctcgtccttaagttcatagtctgtattccctgagtcctatcctgggaaccatcacccggtcacctcctgagcggggcaatctcagctcccctccccctatcagttcggagcccacacgcttggtgcgtgcacatttcaaaaatgaggcgggtccaaagagagggaggaggggaaatgagagaggcccagctactcgcggctttacgggtgcacgtagctcaggcctctgcgcccttgagctaggactggataagcagggcgggaggcggggcgcgcgtcatcagctcccccccaccatccgggttcctataaatacggactgcagccctccctggtgctctctgctcctccctgttccagagtcggccgcatcttcttgtgcagtgccaggtgaaaatcgcggagtgggccgcaggaggccggggacagtcggaaactgggaaggggagtgggcactgtacgggtctagggatgctggtgcgaagtgtgcaagccggacccaggctccgcattgcaggggggggatgatggaggacgtgatggggcgcacggcgggaatggaggcggggtgggggaggggactgcctggtgtccttcgggccacgctaatctcattttcttctcctgcagcctcgtcccgtagacaaacgtctcaggggacacccaagctgtctagagccgccacc

SEQ ID NO: 519 - DNA, 1755 bp, Artificial sequence
  Synthetic
gagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacatacataaggtcaataggggtgactagtaaatcaacgggactctctctttttttttttttttttttttttttttccaaaaggaggggagagggggtaaaaaaatgctgcactgtgcggctaggccggtgagtgagcggcgcggagccaatcagcgctcgccgttccgaaagttgccttttatggctcgagtggccgctgtggcgtcctataaaacccggcggcgcaacgcgcagccactgtcgagtccgcgtccacccgcgagcacaggcctttcgcagctctttcttcgccgctccacacccgccaccaggtaagcagggacaacaggcccagccggccacagccctcccgtgggcagtgaccgcgctgcagggtcgcgggggacactcggcgcggacaccggggaaggctggagggtggtgccgggccgcggagcggacactttcagatccaactttcagtccagggtgtagaccctttacagccgcattgccacggtgtagacaccggtggacccgctctggctcagagcacgcggcttgggggaacccattagggtcgcagtgtgggcgctatgagagccgatgcagctttcgggtgttgaaccgtatctgcccaccttggggggaggacacaaggtcgggagccaaacgccacgatcatgccttggtggcccatgggtctttgtctaaaccggtttgcccatttggcttgccgggcgggcgggcgcggcgggcccggctcggccgggtgggggctgggttgccactgcgcttgcgcgctctatggctgggtattggggcgcgtgcacgctggggagggagcccttcctcttccccctctcccaagttaaacttgcgcgtgcgtattgagacttggagcgcggccaccggggttgggcgagggcggggccgttgtccggaaggggcggggtcgcagaggattcggggcgcctgctcgcgcttcctgctgggtgtggtcgcctcccgcgcgcgcactagaccgcccggcgggggggcgaaggcgggtcttgcgcccgtttggggagggggcggacacctggcttcctgccgtggggccgcctccggaccagcgtttgcctcttatggtaataacgcggccggcctgggcttcatttgtcccctgagtttgggcgcgcgccccctggcggcccgtgaccgcggcttgccggaagtgggcagggcggcaacggctgcgcctagtggcccgccagtgaccgcgaccctcttttgtgccctgatatagttcgccagcctctgctaaccatgttcatgccttcttctttttcctacagcgtctcaggggacacccaagctgtctagagccgccacc

SEQ ID NO: 520 - DNA, 1547 bp, Artificial sequence
  Synthetic
tatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagcctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggtcgtctcaggggacacccaagctgtctagagccgccacc

SEQ ID NO: 521 - DNA, 1797 bp, Artificial sequence
  Synthetic
gagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacatacataaggtcaataggggtgactagtaaatcaacgggacctcttcatcctcttcctcaatctcgctttctctctcgcttttttttttttcttcttctttttttttttttttttcaaaaggaggggagagggggtaaaaaaatgctgcactgtgcggcgaggccggtgagtgagcgacgcggagccaatcagcgcccgccgttccgaaagttgccttttatggctcgagtggccgctgtggcgtcctataaaacccggcggcgcaacgcgcagccactgtcgagtcgcgtccacccgcgagcacagcttctttgcagctccttcgttgccggtccacacccgccaccaggtaagcagggacgccgggcccagcgggccttcgctctctcgtggctagtacctcactgcagggtcctgaggatcactcagaacggacaccatgggcgggtggagggtggtgccgggccgcggagcggacactggcacagccaactttacgcctagcgtgtagactctttgcagccacattcccgcggtgtagacactcgtgggcccgctcccgctcggtgcgtggggcttggggacacactagggtcgcggtgtgggcatttgatgagccggtgcggcttgcgggtgttaaaagccgtattaggtccatcttgagagtacacagtattgggaaccagacgctacgatcacgcctcaatggcctctgggtctttgtccaaaccggtttgcctattcggcttgccgggcgggcgggcgggcgggcgggcgcggcagggccggctcggccgggtgggggctgggatgccactgcgcgtgcgctctctatcactgggcatcgaggcgcgtgtgcgctagggagggacctcttcctctccccctcttcctagttagctgcgcgtgcgtattgaggctgggagcgcggctgcccggggttgggcgagggcggggccgttgtccggaaggggcggggtcacagtggcacgggcgccttgtttgcgcttcctgctgggtgtggtcgcctcccgcgcgcgcacaagccgcccgtcggcgcagtgtaggcggagcttgcgcccgtttggggagggggcggaggtctggcttcctgccctaggtccgcctccgggccagcgtttgccttttatggtaataatgcggccggtctgcgcttcctttgtcccctgagcttgggcgcgcgccccctggcggctcgagcccgcggcttgccggaagtgggcagggcggcagcggctgctcttggcggccccgaggtgactatagccttcttttgtgtcttgatagttcgccagcctctgctaaccatgttcatgccttcttctttttcctacagcgtctcaggggacacccaagctgtctagagccgccacc

SEQ ID NO: 522 - DNA, 769 bp, Artificial sequence
  Synthetic
attgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagactccatccacgctgttttgacctccatagaagataccgggaccgatccagcctccgcggccgggaacggtgcattggaacgcggattccccgtgccaagagtgactcaccgtccttgacacggccgcggggacacccaagctgtctagagccgccacc

SEQ ID NO: 523 - DNA, 904 bp, Artificial sequence
  Synthetic
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 524 - DNA, 1544 bp, Artificial sequence
  Synthetic
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggcctgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 525 - DNA, 1568 bp, Artificial sequence
  Synthetic
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 526 - DNA, 1190 bp, Artificial sequence
  Synthetic
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgactcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 527 - DNA, 922 bp, Artificial sequence
  Synthetic
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 528 - DNA, 1610 bp, Artificial sequence
  Synthetic
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgacctgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 529 - DNA, 1208 bp, Artificial sequence
  Synthetic
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacctcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 530 - DNA, 1488 bp, Artificial sequence
  Synthetic
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 531 - DNA, 1513 bp, Artificial sequence
  Synthetic
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 532 - DNA, 1049 bp, Artificial sequence
  Synthetic
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 533 - DNA, 1036 bp, Artificial sequence
  Synthetic
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcagcctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 534 - DNA, 1786 bp, Artificial sequence
  Synthetic
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 535 - DNA, 810 bp, Artificial sequence
  Synthetic
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgtggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 536 - DNA, 1450 bp, Artificial sequence
  Synthetic
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgtggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggcctgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 537 - DNA, 1474 bp, Artificial sequence
  Synthetic
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgtggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 538 - DNA, 1096 bp, Artificial sequence
  Synthetic
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgtggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgactcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 539 - DNA, 828 bp, Artificial sequence
  Synthetic
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 540 - DNA, 1540 bp, Artificial sequence
  Synthetic
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 541 - DNA, 1114 bp, Artificial sequence
  Synthetic
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacctcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 542 - DNA, 669 bp, Artificial sequence
  Synthetic
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagcctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 543 - DNA, 1394 bp, Artificial sequence
  Synthetic
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 544 - DNA, 1419 bp, Artificial sequence
  Synthetic
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 545 - DNA, 955 bp, Artificial sequence
  Synthetic
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 546 - DNA, 1667 bp, Artificial sequence
  Synthetic
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 547 - DNA, 1692 bp, Artificial sequence
  Synthetic
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 548 - DNA, 1228 bp, Artificial sequence
  Synthetic
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcagtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 549 - DNA, 597 bp, Artificial sequence
  Synthetic
tggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 550 - DNA, 1237 bp, Artificial sequence
  Synthetic
tggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggcctgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 551 - DNA, 1261 bp, Artificial sequence
  Synthetic
tggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 552 - DNA, 883 bp, Artificial sequence
  Synthetic
tggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgactcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 553 - DNA, 1303 bp, Artificial sequence
  Synthetic
agtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgacctgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 554 - DNA, 1327 bp, Artificial sequence
  Synthetic
agtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 555 - DNA, 901 bp, Artificial sequence
  Synthetic
agtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacctcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 556 - DNA, 456 bp, Artificial sequence
  Synthetic
gcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagcctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 557 - DNA, 1206 bp, Artificial sequence
  Synthetic
gcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttagagcttccttcttctttttcctagaagctcagaataaacgctcaactttggccgccacc

SEQ ID NO: 558 - DNA, 729 bp, Artificial sequence
  Synthetic
agcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcagcctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttccttcttctttttcctagaagctcagaataaacgctcaactttggccgccacc

SEQ ID NO: 559 - DNA, 1454 bp, Artificial sequence
  Synthetic
agcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 560 - DNA, 1015 bp, Artificial sequence
  Synthetic
agcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcagtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 561 - DNA, 1181 bp, Artificial sequence
  Synthetic
gcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagagcttccttcttctttttcctagaagctcagaataaacgctcaactttggccgccacc

SEQ ID NO: 562 - DNA, 669 bp, Artificial sequence
  Synthetic
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagccgccacc

SEQ ID NO: 563 - DNA, 575 bp, Artificial sequence
  Synthetic
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagccgccacc

SEQ ID NO: 564 - DNA, 671 bp, Artificial sequence
  Synthetic
gggctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtccaagtttaaacgccgccacc

SEQ ID NO: 565 - DNA, 577 bp, Artificial sequence
  Synthetic
gccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgtggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtccaagtttaaacgccgccacc

SEQ ID NO: 566 - DNA, 462 bp, Artificial sequence
  Synthetic
tcttctttctagactgaccaaagactttttgtcaacttgtacaatctgaagcaatgtctggcccacagacagctgagctgtaaacaaatgtcacatggaaataaatactttatcttgtgaactcactttattgtgaaggaatttgttttgtttttcaaacctttcctgcggtgttgacagcccaaggattatctgaatagagcctaggaactggaaatggaacagtgcagtctgatggtacttaagggagaaagagggaaaggaggtgtggaagaagaaaaaagagaagcaaggggggggggagaaagggagagggagagggagagggagagggagagggagagggagagggagagggagagggagagggagagggagagggagggggagagagagagagagagagagagagagagagagagagagagagagagagagagagagcatgcactctaacagcaa

SEQ ID NO: 567 - DNA, 463 bp, Artificial sequence
  Synthetic
tcttctttctagactgaccaaagactttttgtcaacttgtacaatctgaagcaatgtctggcccacagacagctgagctgtaaacaaatgtcacatggaaataaatactttatcttgtgaactcactttattgtgaaggaatttgttttgtttttcaaacctttcctgcggtgttgacagcccaaggattatctgaatagagcctaggaactggaaatggaacagtgcagtctgatggtacttaagggagaaagagggaaaggaggtgtggaagaagaaaaaagagaagcaagggggagggggagaaagggagagggagagggagagggagagggagagggagagggagagggagagggagagggagagggagagggagggggagggggagagagagagagagagagagagagagagagagagagagagagagagagagagagagcatgcactctaacagcaa

SEQ ID NO: 568 - DNA, 449 bp, Artificial sequence
  Synthetic
gatccttttccctctgaccagaattatgggaacatcatgaagccccttgagcatctagcttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 569 - DNA, 415 bp, Artificial sequence
  Synthetic
tcttctttctagactgaccaaagactttttgtcaacttgtacaatctgaagcaatgtctggcccacagacagctgagctgtaaacaaatgtcacatggaaataaatactttatcttgtgaactcactttattgtgaaggaatttgttttgtttttcaaacctttcctgcggtgttgacagcccaaggattatctgaatagagcctaggaactggaaatggaacagtgcagtctgatggtacttaagggagaaagagggaaaggaggtgtggaagaagaaaaaagagaagcaagggggagggggagaaagggagagggagagggagagggagagggagagggagagggagagggagagggagagggagagggagagggagggggagggggagagagagcatgcactctaacagcaa

SEQ ID NO: 570 - DNA, 284 bp, Artificial sequence
  Synthetic
ttgacttgactcatgcttgtttcactttcacatggaatttcccagttatgaaattaataaaaatcaatggtttccacatctgtgtgtgcctgtgtcaccgacccaggtagggctggccttgggggagggggaggccagaatgactccaagagctacaggaaggcaggtcagagaagggggaggggggggcggcgcgcagtgtggatcttatatctagtccccagggggagggggcaataaaagatctttattttcattagatctgtgtgttggttttttgtgtg

SEQ ID NO: 571 - DNA, 353 bp, Artificial sequence
  Synthetic
ttgacttgactcatgcttgtttcactttcacatggaatttcccagttatgaaattaataaaaatcaatggtttccacatctgtgtgtgcctgtgtcaccgacccaggtagggctggccttgggggagggggaggccagaatgactccaagagctacaggaaggcaggtcagagatcccactggacaaacagtggctggactctgcaccataacacacaatcaacaggggagtgagctggatccagggggaggggggggcggcgcgcagtgtggatcttatatctagtccccagggggagggggcaataaaagatctttattttcattagatctgtgtgttggttttttgtgtg

SEQ ID NO: 572 - DNA, 424 bp, Artificial sequence
  Synthetic
gctggagcctcggtagccgttcctcctgcccgctgggcctcccaacgggccctcctcccctccttgcaccggcccttcctggtctttgaataaactgtacttggctcactctccttctccttacataggaaattacccagttatgaaattaataaaaagccagtgatccccacatttgtctgtgcctctgcctaggggctggcctgggaggggagaaaaaggccagaataattccaggaaccgccaagaaggcaggtcagagatcttgctggacaaacagtggctgaactctgttccttaacagagtcagcagcagggggaggggggggcggcgcgcagtgtggatcttatatctagtccccagggggagggggcaataaaagatctttattttcattagatctgtgtgttggttttttgtgtg

SEQ ID NO: 573 - DNA, 330 bp, Artificial sequence
  Synthetic
ctgtacttggctcactctccttctccttacataggaaattacccagttatgaaattaataaaaagccagtgatccccacatttgtctgtgcctctgcctaggggctggcctgggaggggagaaaaaggccagaataattccaggaaccgccaagaaggcaggtcagagatcttgctggacaaacagtggctgaactctgttccttaacagagtcagcagcagggggaggggggggcggcgcgcagtgtggatcttatatctagtccccagggggagggggcaataaaagatctttattttcattagatctgtgtgttggttttttgtgtg

SEQ ID NO: 574 - DNA, 463 bp, Artificial sequence
  Synthetic
tcttctttctagactgaccaaagactttttgtcaacttgtacaatctgaagcaatgtctggcccacagacagctgagctgtaaacaaatgtcacatggaaataaatactttatcttgtgaactcactttattgtgaaggaatttgttttgtttttcaaacctttcctgcggtgttgacagcccaaggattatctgaatagagcctaggaactggaaatggaacagtgcagtctgatggtacttaagggagaaagagggaaaggaggtgtggaagaagaaaaaagagaagcacgggggagggggagaaagggagagggagagggagagggagagggagagggagagggagagggagagggagagggagagggagagggagggggagggggagagagagagagagagagagagagagagagagagagagagagagagagagagagagcatgcactctaacagcaa

SEQ ID NO: 575 - DNA, 239 bp, Artificial sequence
  Synthetic
ctgtcttccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaagaagacag

SEQ ID NO: 576 - DNA, 147 bp, Artificial sequence
  Synthetic
ctgtcttcccaacttgtttattgcagcttataatggttacaaataaagcaatagcatcacaaatttcacaaataaagcatttttttcactgcattctagttgtggtttgtccaaactcatcaatgtatcttatcatgtcgaagacag

SEQ ID NO: 577 - DNA, 287 bp, Artificial sequence
  Synthetic
ctgtcttcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccataggaagacag

SEQ ID NO: 578 - DNA, 65 bp, Artificial sequence
  Synthetic
ctgtcttcaataaaagatctttattttcattagatctgtgtgttggttttttgtgtggaagacag

SEQ ID NO: 579 - DNA, 264 bp, Artificial sequence
  Synthetic
ctgtcttcccaacttgtttattgcagcttataatggttacaaataaagcaatagcatcacaaatttcacaaataaagcatttttttcactgcattctagttgtggtttgtccaaactcatcaatgtatcttatcatgtcaaatcgataatatatggtagggttcatagccagagtaacctttttttttaatttttattttattttatttttgagtcgggcgcgccaaaatgaagtgaagttcctatactttctagagaagacag

SEQ ID NO: 580 - DNA, 404 bp, Artificial sequence
  Synthetic
ctgtcttcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagaagacag

SEQ ID NO: 581 - DNA, 347 bp, Artificial sequence
  Synthetic
ctgtcttcatccacaagcccagctccccacccatcaccatggacaatgtttttttactaacacttggacaatgatggatacttttttactaacacttggacaatgatgatgatacactcctcacttgcccacttagacacaattactaacaccacaccccctcttttatttctctgtacttaatgttttctgaataaagtgatcctattgtacccacattaaagacttctttaactctttatggttcacaggacccgagatgaacatagatattgttacagcagcggcctccatgtcaggtataactactgcctcacacagcgccctgccaatcagaaggaagacag

SEQ ID NO: 582 - DNA, 280 bp, Artificial sequence
  Synthetic
tgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctc

SEQ ID NO: 583 - DNA, 852 bp, Artificial sequence
  Synthetic
aatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctc

SEQ ID NO: 584 - DNA, 675 bp, Artificial sequence
  Synthetic
aaatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaatacaagtttaatgagaagtctgtctctgttaatgctgaagtcattactaagtgcttagcttagcaaggtatgtggatgcccatttgtgttccaagggattggactgttcatcaggacccagagctgtgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctc

SEQ ID NO: 585 - DNA, 666 bp, Artificial sequence
  Synthetic
tggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaagttaaatgagaa

SEQ ID NO: 586 - DNA, 403 bp, Artificial sequence
  Synthetic
ctgtcttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcgaagacag

SEQ ID NO: 587 - DNA, 469 bp, Artificial sequence
  Synthetic
gctggagcctcggtagccgttcctcctgcccgctgggcctcccaacgggccctcctcccctccttgcaccggcccttcctggtctttgaataaagtttacctgactcatggtcctttcactttcacatgggatttcccagttatgaaattaataaaaatcagtgatttccacatctgtgtgtgcctgtgccaggctgggtggggaacaggaggccgagatgattccgggaactgtcagaaggaatcaatgatttccacatcctgtctgtcttatgtcttggggggtggggaggccaggaagattccaggaaggtcagagtcaatcaatggtttccacatctctcagtgcctctatctggaggccaggtagggctggccttgggggagggggaggccagaatgactccaagagctacaggaaggggggagggggaaaaaggccagaataattccaggaaccgccaagaag

SEQ ID NO: 588 - DNA, 682 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaa

SEQ ID NO: 589 - DNA, 748 bp, Artificial sequence
  Synthetic
gctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaa

SEQ ID NO: 590 - DNA, 851 bp, Artificial sequence
  Synthetic
atattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctc

SEQ ID NO: 591 - DNA, 760 bp, Artificial sequence
  Synthetic
gctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaagttaaatgagaa

SEQ ID NO: 592 - DNA, 358 bp, Artificial sequence
  Synthetic
ctgtcttcccgctggagcctcggtagccgttcctcctgcccgctgggcctcccaacgggccctcctcccctccttgcaccggcccttcctggtctttgaataaaaacttgtttattgcagcttataatggttacaaataaagcaatagcatcacaaatttcacaaataaagcatttttttcactgcattctagttgtggtttgtccaaactcatcaatgtatcttatcatgtcaaatcgataatatatggtagggttcatagccagagtaacctttttttttaatttttattttattttatttttgagtcgggcgcgccaaaatgaagtgaagttcctatactttctagagaagacag

SEQ ID NO: 593 - DNA, 447 bp, Artificial sequence
  Synthetic
gctggagcctcggtagccgttcctcctgcccgctgggcctcccaacgggccctcctcccctccttgcaccggcccttcctggtctttgaataaattgacttgactcatgcttgtttcactttcacatggaatttcccagttatgaaattaataaaaatcaatggtttccacatctgtgtgtgcctgtgtcaccgacccaggtagggctggccttgggggagggggaggccagaatgactccaagagctacaggaaggcaggtcagagatcccactggacaaacagtggctggactctgcaccataacacacaatcaacaggggagtgagctggatccagggggaggggggggcggcgcgcagtgtggatcttatatctagtccccagggggagggggcaataaaagatctttattttcattagatctgtgtgttggttttttgtgtg

SEQ ID NO: 594 - DNA, 333 bp, Artificial sequence
  Synthetic
ctgtcttcgctggagcctcggtagccgttcctcctgcccgctgggcctcccaacgggccctcctcccctccttgcaccggcccttcctggtctttgaataaacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaagaagacag

SEQ ID NO: 595 - DNA, 543 bp, Artificial sequence
  Synthetic
gctggagcctcggtagccgttcctcctgcccgctgggcctcccaacgggccctcctcccctccttgcaccggcccttcctggtctttgaataaagatccttttccctctgaccagaattatgggaacatcatgaagccccttgagcatctagcttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 596 - DNA, 1509 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagaaacttgatctgtcgccgcaattcaagcttcgtgaggctccggtgcccgtcagtgacctgctatactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagcgtctcaggggcgagacctctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagagggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaagccgccacc

SEQ ID NO: 597 - DNA, 1904 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggcgagaccagcttgcttgttctttttgcagaagctcagaataaacgctcaactttggccgccacc

SEQ ID NO: 598 - DNA, 1383 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagaaacttgatctgtcgccgcaattcaagcttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggcgagaccagcttgcttgttctttttgcagaagctcagaataaacgctcaactttggccgccacc

SEQ ID NO: 599 - DNA, 2120 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgactacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggcgagaccggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccaccagcttgcttgttctttttgcagaagctcagaataaacgctcaactttggccgccacc

SEQ ID NO: 600 - DNA, 1007 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagaaacttgatctgtcgccgcaattcaaacttcgtgaggctccggtgcccgtcagtgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagccatctattgcttacatttgcttctgacacaactgtgttcactagcaacctcaaacagacacca

SEQ ID NO: 601 - DNA, 2033 bp, Artificial sequence
  Synthetic
gctcttctatgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagtaaggttaaaaaattccgccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaacgtctaggccccccgaaccacggggacgtggttttcctttgaaaaacacgatgataatatggccacaaccatggtgtcaaaaggggaggaattgatcaaagagaacatgcatatgaaactgtacatggagggaactgtcaacaatcaccacttcaaatgcacctcagagggcgagggaaagccctacgaagggacccagaccatgcgcattaaggtggtcgaaggcggaccactcccttttgcattcgacatcctggctacctccttcatgtacggatcgcgcacttttatcaagtacccgaaggggatcccggacttcttcaagcaatccttccctgagggattcacttgggaacgggtcacgacctacgaagatggaggcgtggtgaccgtgatgcaagacactagcctggaagatggctgccttgtctacaacgtgaagatcagaggtgtgaacttcccatccaatggccccgtgatgcagaaaaagactctggggtgggaagccaataccgaaatgctctacccagcggacggaggactcgaaggccggtctgacatggccctgaagctggtcggaggaggacatttgtcgtgtagctttgtgactacgtaccggtcgaagaagccggccaaaaacctgaagatgccgggtatccacgcggtggaccatagactggaacgcctggaggagagcgataacgagatgttcgtcgttcagagggaacacgctgtggcacgatattgcgatctcccgtcgaagcttggtcacaagctcaattagggtagaagagc

SEQ ID NO: 602 - DNA, 2032 bp, Artificial sequence
  Synthetic
attatccctaatacctgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgacacccattaaaaaagttaaatgagaaacctgtgtgttcctttggagaggggcggaagggacgttaggagggaggcagggaggcagggaggcagggaggaacggagggaggaaacttgatctgtcgccgcaattcaagcttcgtgaggctccggtgcccgtcagtgacctgctatactctggagacgctgggaagggtccctaggattgtgcacctctcccgcgggggacaagcaggggatggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgttctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaaggtgttgtgaaaaccaccgctaattcaaatccaacagcttgcttgttctttttgcagaagctcagaataaacgctcaactttggccgccacc

SEQ ID NO: 603 - DNA, 1979 bp, Artificial sequence
  Synthetic
attatccctaatacctgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgacacccattaaaaaagttaaatgagaaacctgtgtgttcctttggagaggggcggaagggacgttaggagggaggcagggaggcagggaggcagggaggaacggagggaggaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagctaattcaaatccaacagcttgcttgttctttttgcagaagctcagaataaacgctcaactttggccgccacc

SEQ ID NO: 604 - DNA, 2561 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaacgtctcaggggctgtcttcgcaggagcccgggctgggcataaaagtcagggcagagccatctattgcttacatttgcttctgacacaactgtgttcactagcaacctcaaacagacacc

SEQ ID NO: 605 - DNA, 2560 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaacgtctcaggggctgtcttcgcaggagcccgggctgggcataaaagtcagggcagagccatctattgcttacatttgcttctgacacaactgtgttcactagcaacctcaaacagacacc

SEQ ID NO: 606 - DNA, 2010 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagtctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagagggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaagccgccacc

SEQ ID NO: 607 - DNA, 2046 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacaacctttggagctaagccagcaatggtagagggaagattctgcacgtcccttccaggcggcctccccgtcaccaccccccccaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgtttctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagagggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaagccgccacc

SEQ ID NO: 608 - DNA, 2100 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaaggggtagcttgcttgttctttttgcagaagctcagaataaacgctcaactttggccgccacc

SEQ ID NO: 609 - DNA, 2758 bp, Artificial sequence
  Synthetic
atattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcctctggagacggtagcatccttaggatcgagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacatacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgaccttccccggctactgaagcgcatcggacccgctcggttctattgggaccacgcccatccgccatattggaacagccgccatattggtaacgccgccatcttgattgggaccaccgcccctattgggaccaccgcccaattgggaccaccgcccacccagcgacccaggcccagaggctacgtcaccaggacccccggctgcccagcgccccctcgaggacacacaatgtaagtagaccaaggccttttattggctgcggtgttaaggcaagctgcctgtctatccctatctatctactatccacctggctctctagctccatactgcgtacggtgtttgttagcttagggtgatagcaagtagaacgctggtgatggttgctctctatcagtttagcgctggtgatggtggcctccttctccatttcttatatatatatgctggtgatggtccctcttccatggccgcggtgtgcttcggtgccgggtaccgtaacgtggtacagaaaaaggcctgacacgtacgcttctctccctaggatgctatgtgtctgtagcaccggcggagcttgcgagctcgatgtccaagatagagtctccatgactgctcagattgtctcctgtgttcacacaccagatattacaagcgacggccgccatgataagtccaaaaatgagcagaatacagaatattgtactcagaggctgcagccatcttggtggcctgctgtggtgctcttttcccgtggaggactccgtcagttcctgcgtgttgttgctcgtactgcgaagatctctcttgccccgtcctgaaaacctaggccctgacagaaaaaagggagagttaggagagggcacagaggattctgtctgtgtcaagggggcttccatgttgtttctttacctgagatctcttccaccagttgttttttatcagcaactgacaggtagtatatcaaaatgagtgcactgatgattattagcactgtatactttagatatcttctggtttctgtggacatctgttgatgataaaaaattatatttttttagagagcgtctcaggggtgtgtcgtgaaaactacccctagccgccacc

SEQ ID NO: 610 - DNA, 4113 bp, Artificial sequence
  Synthetic
ggggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcacgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcgtcggtcgggctgcaaccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattcggcttgatcgaagccgtctcaggggagagaccacacccaagctgtctagagccgccaccttatattccccagaacatcaggttaatggcgtttttgatgtcattttcgcggtggctgagatcagccacttcttccccgataacggaaaccggcacactggccatatcggtggtcatcatgcgccagctttcatccccgatatgcaccaccgggtaaagttcacgggagactttatctgacagcagacgtgcactggccagggggatcaccatccgtcgcccgggcgtgtcaataatatcactctgtacatccacaaacagacgataacggctctctcttttataggtgtaaaccttaaactgcatttcaccagcccctgttctcgtcagcaaaagagccgttcatttcaataaaccgggcgacctcagccatcccttcctgattttccgctttccagcgttcggcacgcagacgacgggcttcattctgcatggttgtgcttaccagaccggagatattgacatcatatatgccttgagcaactgatagctgtcgctgtcaactgtcactgtaatacgctgcttcatagcatacctctttttgacatacttcgggtatacatatcagtatatattcttataccgcaaaaatcagcgcgcaaatacgcatactgttatctggcttttagtaagccgacgcactttgcgccgaataaatacctgtgacggaagatcacttcgcagaataaataaatcctggtgtccctgttgataccgggaagccctgggccaacttttggcgaaaatgacacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtgtcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggggggcgtaaacgccgtgaggtctctaaaactgtcttc

SEQ ID NO: 611 - DNA, 2436 bp, Artificial sequence
  Synthetic
cttgctcacctcgagtacgatagccggctaatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaattcggacggtgactgcagtgaataataaaatgtgtgtttgtccgaaatacgcgttttgagatttctctggagacgctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttgacacgcgtctcaggggcgtgtcgtgaaaactacccctagccgccacc

SEQ ID NO: 612 - DNA, 2042 bp, Artificial sequence
  Synthetic
atattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcctctggagacggtagcatccttaggatcgagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgctcagatcgcctggagaggccatccacgctgttttgacctccatagtggacaccgggaccgatccagcctccgcggccgggaacggtgcattggaacgcggattccccgtgccaagagtgacgtaagtctgttgacatgtatgtgatgtatactaatctgcatgggacgtggatttacttgtgtatgtcagatagagtaaagattaactcttgcatgtgagcggggcatcgagatagcgataaatgagtcaggaggacggatacttatatgtgttgttatcctcctctacagagcctctgctaaccatgttcatgccttcttctttttcctacagctccgtctcaggggcaagcttgcttgttctttttgcagaagctcagaataaacgctcaactttggccgccacc

SEQ ID NO: 613 - DNA, 1836 bp, Artificial sequence
  Synthetic
ccgcctaggactgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 614 - DNA, 1923 bp, Artificial sequence
  Synthetic
ccgcctaggactgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 615 - DNA, 2494 bp, Artificial sequence
  Synthetic
ccgcctaggacatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 616 - DNA, 901 bp, Artificial sequence
  Synthetic
tgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacccgtctcaggggcttcgcaggtacacccaagctgtctagagccgccacc

SEQ ID NO: 617 - DNA, 1545 bp, Artificial sequence
  Synthetic
ccgcctaggacatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgagcttgcttgttctttttgcagaagctcagaataaacgctcaactttggccgccacc

SEQ ID NO: 618 - DNA, 2101 bp, Artificial sequence
  Synthetic
ccgcctaggacatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccagcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacaccatctattgcttacatttgcttctgacacaactgtgttcactagcaacctcaaacagacacc

SEQ ID NO: 619 - DNA, 2485 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagatagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatacgaaacttgatctgtcgccgcaattcaagcttcgtgaggctccggtgcccgtcagtgacctgctatagaaacttgatctgtcgccgcaattcaagcttcgtgaggctccggtgcccgtcagtgacctgctatactctgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagcaggagcccgggctgggcataaaagtcagggcagagccatctattgcttacatttgcttctgacacaactgtgttcactagcaacctcaaacagacacc

SEQ ID NO: 620 - DNA, 2772 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagatagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatacaacattttaagaactaagaacctctcttctatgcttagtagatgaacaaaatcatgtaatagatgaatgaggccaggaagtacaaaggtttacaaaattgccaagccactctggggtgattttatgagtaatgcggcatttggtagcttgccttaaagaatattattggacattatcaagtgtgtgtgtgtgtgtgtgtgtgtgtgtgtgtgtgtgtaactgaactctcttgtagtttcatttttgtttgaaaaagacatgtatctcatgtagcccaggctggaatcgaaacttgatctgtcgccgcaattcaagcttcgtgaggctccggtgcccgtcagtgacctgctatagaaacttgatctgtcgccgcaattcaagcttcgtgaggctccggtgcccgtcagtgacctgctatactctgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagcaggagcccgggctgggcataaaagtcagggcagagccatctattgcttacatttgcttctgacacaactgtgttcactagcaacctcaaacagacacc

SEQ ID NO: 621 - DNA, 2831 bp, Artificial sequence
  Synthetic
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaaaactacccctaaaagccacc

SEQ ID NO: 622 - DNA, 2890 bp, Artificial sequence
  Synthetic
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaacc

SEQ ID NO: 623 - DNA, 2844 bp, Artificial sequence
  Synthetic
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaacc

SEQ ID NO: 624 - DNA, 2858 bp, Artificial sequence
  Synthetic
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcagacatttgcttctgacacaactgtgttcactagcaacctcaaacagacacc

SEQ ID NO: 625 - DNA, 1083 bp, Artificial sequence
  Synthetic
attatccctaatacctgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgacacccattaaaaaagttaaatgagaaacctgtgtgttcctttggagaggggcggaagggacgttaggagggaggcagggaggcagggaggcagggaggaacggagggaggaaacttgatctgtcgccgcaattcaagcttcgtgaggctccggtgcccgtcagtgacctgctataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgagcttgcttgttctttttgcagaagctcagaataaacgctcaactttggccgccacc

SEQ ID NO: 626 - DNA, 1503 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagatagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatacgaaacttgatctgtcgccgcaattcaagcttcgtgaggctccggtgcccgtcagtgacctgctataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgagcttgcttgttctttttgcagaagctcagaataaacgctcaactttggccgccacc

SEQ ID NO: 627 - DNA, 991 bp, Artificial sequence
  Synthetic
atctgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaaacttgatctgtcgccgcaattcaagcttcgtgaggctccggtgcccgtcagtgacctgctataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgagcttgcttgttctttttgcagaagctcagaataaacgctcaactttggccgccacc

SEQ ID NO: 628 - DNA, 1476 bp, Artificial sequence
  Synthetic
cttgctcacctcgagtacgatagccggctaatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaattcggacggtgactgcagtgaataataaaatgtgtgtttgtccgaaatacgcgttttgagatttctctggagtcgctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgagcttgcttgttctttttgcagaagctcagaataaacgctcaactttggccgccacc

SEQ ID NO: 629 - DNA, 2277 bp, Artificial sequence
  Synthetic
cttgctcacctcgagtacgatagccggctaatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggtattcggacggtgacgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagataccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttgacacgaagtttgctcgagccacc

SEQ ID NO: 630 - DNA, 1698 bp, Artificial sequence
  Synthetic
cttgctcacctcgagtacgatagccggctaatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggtattcggacggtgacgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaatttcaccgtccttgacacgaagtttgctcgagccacc

SEQ ID NO: 631 - DNA, 2450 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 632 - DNA, 2407 bp, Artificial sequence
  Synthetic
ccgcctaggacatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 633 - DNA, 1820 bp, Artificial sequence
  Synthetic
ccgcctaggactgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaaaccaccgctaattcaaagcaagccgccacc

SEQ ID NO: 634 - DNA, 2478 bp, Artificial sequence
  Synthetic
ccgcctaggacatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaaaccaccgctaattcaaagcaagccgccacc

SEQ ID NO: 635 - DNA, 2394 bp, Artificial sequence
  Synthetic
taatcgagtacgatagccggctaatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaattcggacggtgactgcagtgaataataaaatgtgtgtttgtccgaaatacgcgttttgagatttctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttgacacgaagtttgctcgagccacc

SEQ ID NO: 636 - DNA, 2498 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaaagcttgcttgttctttttgcagaagctcagaataaacgctcaactttggccgccacc

SEQ ID NO: 637 - DNA, 1906 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaatttcaccgtccttgacacgaagtttgctcgagccacc

SEQ ID NO: 638 - DNA, 1996 bp, Artificial sequence
  Synthetic
tgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcggccgccatctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcctgaacacgtctcaagcttgcttgttctttttgcagaagctcagaataaacgctcaactttggccgccacc

SEQ ID NO: 639 - DNA, 1411 bp, Artificial sequence
  Synthetic
tgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcggccgccatctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaaggggtagcttgcttgttctttttgcagaagctcagaataaacgctcaactttggccgccacc

SEQ ID NO: 640 - DNA, 917 bp, Artificial sequence
  Synthetic
tgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacccgtctcaagcttgcttgttctttttgcagaagctcagaataaacgctcaactttggccgccacc

SEQ ID NO: 641 - DNA, 1797 bp, Artificial sequence
  Synthetic
tgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcggccgccaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaaagcttgcttgttctttttgcagaagctcagaataaacgctcaactttggccgccacc

SEQ ID NO: 642 - DNA, 2359 bp, Artificial sequence
  Synthetic
gggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcctgaacacgtctcaagcttgcttgttctttttgcagaagctcagaataaacgctcaactttggccgccacc

SEQ ID NO: 643 - DNA, 1774 bp, Artificial sequence
  Synthetic
gggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaaggggtagcttgcttgttctttttgcagaagctcagaataaacgctcaactttggccgccacc

SEQ ID NO: 644 - DNA, 1300 bp, Artificial sequence
  Synthetic
gggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacccgtctcaagcttgcttgttctttttgcagaagctcagaataaacgctcaactttggccgccacc

SEQ ID NO: 645 - DNA, 2172 bp, Artificial sequence
  Synthetic
gggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaaagcttgcttgttctttttgcagaagctcagaataaacgctcaactttggccgccacc

SEQ ID NO: 646 - DNA, 3976 bp, Artificial sequence
  Synthetic
gggtaatcgagtacgatagccggctaatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaattcggacggtgactgggcctttcgcccgggctaattatggggtgtcgcccttcgctgaaggccctccgcgcctacagctcaagccacatccgaagggggagggagccgggagctgcgcgcggggccgccggggggaggggtggcaccgcccacgccgggcggccacgaagggcggggcagcgggcgcgcgcccggcggggggaggggccgcgcgccgcgcccgctgggaattggggccctagggggagggcggaggcgccgacgaccgcggcacttaccgttcgcggcgtggcgcccggtggtccccaaggggagggaagggggaggcggggcgaggacagtgaccggagtctcctcagcggtggcttttctgcttggcagcctcagcggctggcgccaaaaccggactccgcccacttcctcgcccctgcggtgcgagggtgtggaatcctccagacgctgggggagggggagttgggagcttaaaaactagtacccctttgggaccactttcagcagcgaactctcctgtacaccaggggtcagttccacagacgcgggccaggggtgggtcattgcggcgtgaacaataatttgactagaagttgattcgggtgtttccggaaggggccgagtcaatccgccgagttggggcacggaaaacaaaaagggaaggctactaagatttttctggcgggggttatcattggcgtaactgcagggaccacctcccgggttgagggggctggatctccaggctgcggattaagcccctcccgtcggcgttaatttcaaactgcgcgaccgtttctcacctgccttgcgccaaggcagggggcgggaccctattccaagaggtagtaactagcaggactctagccttccgcaattcattgagcgcatttacggaagtaacgtcgggtactgtctctggccgcaagggtgggaggagtacgcatttggcgtaaggtggggcgtagagccttcccgccattggcggcggatagggcgtttacgcgacggcctgacgtagcggatgacgcgttagtgggggggaaggttctagaaaagcggcggcagcggctctagcggcagtagcagcagcgccgggtcccgtgcggaggtgctcctcgcagagttgtttctcgagcagcggcagttctcactacagcgccaggacgagtccggttcgtgttcgtccgcggagatcgatctctctcatctcgctcggctgcgggaaatcgggctgaagcgactgagtccgcgatggaggtaacgggtttgaaatcaatgagttattgaaaagggcatggcgaggccgttggcgcctcagtggaagtcggccagccgcctccgtgggagagaggcaggaaatcggaccaattcagtagcagtggggcttaaggtttatgaacggggtcttgagcggaggcctgagcgtacaaacagcttccccaccctcagcctcccggcgccatttcccttcactgggggtgggggatggggagctttcacatggcggacgctgccccgctggggtgaaagtggggcgcggaggcgggaattcttattccctttctaaagcacgctgcttcgggggccacggcgactcctcggcgtccgaaatacgcgttttgagatttctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttgacacgaagtttgctcgagccacc

SEQ ID NO: 647 - DNA, 2562 bp, Artificial sequence
  Synthetic
ccgcctaggacataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 648 - DNA, 3220 bp, Artificial sequence
  Synthetic
ccgcctaggacataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 649 - DNA, 1469 bp, Artificial sequence
  Synthetic
ccgcctaggactgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 650 - DNA, 1824 bp, Artificial sequence
  Synthetic
tggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctattcggacggtgacgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaatttcaccgtccttgacacgaagtttgctgccgccacc

SEQ ID NO: 651 - DNA, 2229 bp, Artificial sequence
  Synthetic
atattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaatacaagtttaatgagaagtctgtctctgttaatgctgaagtcattactaagtgcttagcttagcaaggtatgtggatgcccatttgtgttccaagggattggactgttcatcaggacccagagctgtgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgttaaatgagaaacctgtgtgttcctttggggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgttctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaaggtgttgtgaaaaccaccgctaattcaaatccaacagcttgcttgttctttttgcagaagctcagaataaacgctcaactttggccgccacc

SEQ ID NO: 652 - DNA, 1824 bp, Artificial sequence
  Synthetic
ccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatcccctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 653 - DNA, 2344 bp, Artificial sequence
  Synthetic
atattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaatacaagtttaatgagaagtctgtctctgttaatgctgaagtcattactaagtgcttagcttagcaaggtatgtggatgcccatttgtgttccaagggattggactgttcatcaggacccagagctgatccacaagcccagctccccacccatcaccatggacaatgtttttttactaacacttggacaatgatggatacttttttactaacacttggacaatgatgatgatacactcctcacttgcccacttagacacaattactaacaccacaccccctcttttatttctctgtacttaatgttttctgaataaagtgatcctattgtacccacattaaagacttctttaactctttatggttcacaggacccgagatgaacatagatattgttacagcagcggcctccatgtcaggtataactactgcctcacacagcgccctgccaatcagaaggttaaatgagaaacctgtgtgttcctttggggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacagctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaaggtgttgtgaaaaccaccgctaattcaaatccaacagcttgcttgttctttttgcagaagctcagaataaacgctcaactttggccgccacc

SEQ ID NO: 654 - DNA, 1088 bp, Artificial sequence
  Synthetic
atccacaagcccagctccccacccatcaccatggacaatgtttttttactaacacttggacaatgatggatacttttttactaacacttggacaatgatgatgatacactcctcacttgcccacttagacacaattactaacaccacaccccctcttttatttctctgtacttaatgttttctgaataaagtgatcctattgtacccacattaaagacttctttaactctttatggttcacaggacccgagatgaacatagatattgttacagcagcggcctccatgtcaggtataactactgcctcacacagcgccctgccaatcagaaggatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgtcagatcgcctggagacgccccgtgtctacccatcagacaagtaagtttctgtttccatttcctctcttgtgacacatttcatgactctgcatttacataacccctgactcatggtcttcccactcttgttctctcagggtgccagctcagcttgcttgttctttttgcagaagctcagaataaacgctcaactttggccgccacc

SEQ ID NO: 655 - DNA, 1073 bp, Artificial sequence
  Synthetic
ccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgtcagatcgcctggagacgccccgtgtctacccatcagacaagtaagtttctgtttccatttcctctcttgtgacacatttcatgactctgcatttacataacccctgactcatggtcttcccactcttgttctctcagggtgccagctcagcttgcttgttctttttgcagaagctcagaataaacgctcaactttggccgccacc

SEQ ID NO: 656 - DNA, 1222 bp, Artificial sequence
  Synthetic
ccgcctaggacccacagacctggtgaccgtcaggaagaagattcagtgagaggacacgaggtatgtcatggtttttaatcaataaataaagaggttttattcatcggacagtcgttgtagcctgtaaaagactcgccccggagggggttcccccgatgtgaggggcatgcagtagtatggtgtcctgagtgtctcggatgcgtccttgaactcgcactctaccgccgtgggggttaataaagttttgctgcgccggtagggggggaggccgaggataataaagttgctacgtactggttgaagtctaacaatctctcggggggatccgaattcgtttatcggccaccgaggccaagatctggccgccaattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatctcgcagtcttgggtctgaccaccgtagaacgcagagctcctcgctgtcagatcgcctggagacgccccgtgtctacccatcagacaagtaagtttctgtttccatttcctctcttgtgacacatttcatgactctgcatttacataacccctgactcatggtcttcccactcttgttctctcagggtgccagctcagcttgcttgttctttttgcagaagctcagaataaacgctcaactttggccgccacc

SEQ ID NO: 657 - DNA, 1692 bp, Artificial sequence
  Synthetic
tggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctattcggacggtgacgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacgatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaatttcaccgtccttgacacgaagtttgctgccgccacc

SEQ ID NO: 658 - DNA, 1373 bp, Artificial sequence
  Synthetic
tgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 659 - DNA, 1785 bp, Artificial sequence
  Synthetic
atctgtatactctatattatactctatgttatactctgtaatcctactcaataaacgtgtcacgcctgtgaaaccgtactaagtctcccgtgtattcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 660 - DNA, 1725 bp, Artificial sequence
  Synthetic
atctgtatactctatattatactctatgttatactctgtaatcctactcaataaacgtgtcacgcctgtgaaaccgtactaagtctcccgtgtattcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaaaactaccagcttgcttgttctttttgcagaagctcagaataaacgctcaactttggccgccacc

SEQ ID NO: 661 - DNA, 2451 bp, Artificial sequence
  Synthetic
atcataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcacctggagtggagcaaacctcatcgggaccgacaattctgtcgtactctcccgcaagtcatcatcgtttccttggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctgtatactctatattatactctatgttatactctgtaatcctactcaataaacgtgtcacgcctgtgaaaccgtactaagtctcccgtgtattcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaaaactaccagcttgcttgttctttttgcagaagctcagaataaacgctcaactttggccgccacc

SEQ ID NO: 662 - DNA, 1425 bp, Artificial sequence
  Synthetic
cttgctcacctcgagtacgatagccggctaatcagccaatccacaagcccagctccccacccatcaccatggacaatgtttttttactaacacttggacaatgatggatacttttttactaacacttggacaatgatgatgatacactcctcacttgcccacttagacacaattactaacaccacaccccctcttttatttctctgtacttaatgttttctgaataaagtgatcctattgtacccacattaaagacttctttaactctttatggttcacaggacccgagatgaacatagatattgttacagcagcggcctccatgtcaggtataactactgcctcacacagcgccctgccaatcagaagcatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaatttcaccgtccttgacacgaagtttgctgccgccacc

SEQ ID NO: 663 - DNA, 3133 bp, Artificial sequence
  Synthetic
ccgcctaggacataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcacctggagtggagcaaacctcatcgggaccgacaattctgtcgtactctcccgcaagtcatcatcgtttccttggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 664 - DNA, 3070 bp, Artificial sequence
  Synthetic
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcacctggagtggagcaaacctcatcgggaccgacaattctgtcgtactctcccgcaagtcatcatcgtttccttggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaatacaagtttaatgagaagtctgtctctgttaatgctgaagtcattactaagtgcttagcttagcaaggtatgtggatgcccatttgtgttccaagggattggactgttcatcaggacccagagctgatccacaagcccagctccccacccatcaccatggacaatgtttttttactaacacttggacaatgatggatacttttttactaacacttggacaatgatgatgatacactcctcacttgcccacttagacacaattactaacaccacaccccctcttttatttctctgtacttaatgttttctgaataaagtgatcctattgtacccacattaaagacttctttaactctttatggttcacaggacccgagatgaacatagatattgttacagcagcggcctccatgtcaggtataactactgcctcacacagcgccctgccaatcagaaggttaaatgagaaacctgtgtgttcctttggggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacagctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaaggtgttgtgaaaaccaccgctaattcaaatccaacagcttgcttgttctttttgcagaagctcagaataaacgctcaactttggccgccacc

SEQ ID NO: 665 - DNA, 2546 bp, Artificial sequence
  Synthetic
ccgcctaggacataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcacctggagtggagcaaacctcatcgggaccgacaattctgtcgtactctcccgcaagtcatcatcgtttccttggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaaaccaccgctaattcaaagcaagccgccacc

SEQ ID NO: 666 - DNA, 3175 bp, Artificial sequence
  Synthetic
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcacctggagtggagcaaacctcatcgggaccgacaattctgtcgtactctcccgcaagtcatcatcgtttccttggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctctcctttggggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacagctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaaggtgttgtgaaaaccaccgctaattcaaatccaacagcttgcttgttctttttgcagaagctcagaataaacgctcaactttggccgccacc

SEQ ID NO: 667 - DNA, 3117 bp, Artificial sequence
  Synthetic
ccgcctaggacataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcacctggagtggagcaaacctcatcgggaccgacaattctgtcgtactctcccgcaagtcatcatcgtttccttggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaaaccaccgctaattcaaagcaagccgccacc

SEQ ID NO: 668 - DNA, 2730 bp, Artificial sequence
  Synthetic
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcacctggagtggagcaaacctcatcgggaccgacaattctgtcgtactctcccgcaagtcatcatcgtttccttggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctctcctttggggccgccaattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 669 - DNA, 3231 bp, Artificial sequence
  Synthetic
ccgcctaggacataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcacctggagtggagcaaacctcatcgggaccgacaattctgtcgtactctcccgcaagtcatcatcgtttccttggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 670 - DNA, 2985 bp, Artificial sequence
  Synthetic
ccgcctaggacaacctttagattataaaatctgtgaaaggttaacaggcattctgaattatgttggtccttttactaaatgtggttatgctgctctccttcctttgtatcaagctacttcgcgtacggcatttgtgttttcttctctctaccacatctggttgctgtccctttatgctgagttgtggcctgttgccaggcaacgaggcgtggtgtgctctgtgtctgacgcaaccccctctggttggggcatttgcaccacctatcaactcatttccccgacgggcgcttttgccctgccgatcgccaccgcggacgtcatcgccgcatgccttgcgcgctgctggacaggcgctcggctgttaggcactgacaactcggtggttctttcgggcaaactgacttcctttccttggctgctcgcctctgttgccaactggattcttcgcgggacgtcgttctgctacgtgccttcggcagcgaatccggcggaccttccttctcgaggccttctgccggctctgcatcccgtgccgactctccgcttccgtccgcagctgagtcgcatctccctttggcccgcctccccgatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 671 - DNA, 3083 bp, Artificial sequence
  Synthetic
ccgcctaggacaacctttagattataaaatctgtgaaaggttaacaggcattctgaattatgttggtccttttactaaatgtggttatgctgctctccttcctttgtatcaagctacttcgcgtacggcatttgtgttttcttctctctaccacatctggttgctgtccctttatgctgagttgtggcctgttgccaggcaacgaggcgtggtgtgctctgtgtctgacgcaaccccctctggttggggcatttgcaccacctatcaactcatttccccgacgggcgcttttgccctgccgatcgccaccgcggacgtcatcgccgcatgccttgcgcgctgctggacaggcgctcggctgttaggcactgacaactcggtggttctttcgggcaaactgacttcctttccttggctgctcgcctctgttgccaactggattcttcgcgggacgtcgttctgctacgtgccttcggcagcgaatccggcggaccttccttctcgaggccttctgccggctctgcatcccgtgccgactctccgcttccgtccgcagctgagtcgcatctccctttggcccgcctccccggggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 672 - DNA, 3220 bp, Artificial sequence
  Synthetic
ccgcctaggacataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcacctggagtggagcaaacctcatcgggaccgacaattctgtcgtactctcccgcaagtcatcatcgtttccttggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 673 - DNA, 3072 bp, Artificial sequence
  Synthetic
ccgcctaggacaacctttagattataaaatctgtgaaaggttaacaggcattctgaattatgttggtccttttactaaatgtggttatgctgctctccttcctttgtatcaagctacttcgcgtacggcatttgtgttttcttctctctaccacatctggttgctgtccctttatgctgagttgtggcctgttgccaggcaacgaggcgtggtgtgctctgtgtctgacgcaaccccctctggttggggcatttgcaccacctatcaactcatttccccgacgggcgcttttgccctgccgatcgccaccgcggacgtcatcgccgcatgccttgcgcgctgctggacaggcgctcggctgttaggcactgacaactcggtggttctttcgggcaaactgacttcctttccttggctgctcgcctctgttgccaactggattcttcgcgggacgtcgttctgctacgtgccttcggcagcgaatccggcggaccttccttctcgaggccttctgccggctctgcatcccgtgccgactctccgcttccgtccgcagctgagtcgcatctccctttggcccgcctccccgatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 674 - DNA, 2492 bp, Artificial sequence
  Synthetic
ccgcctaggacaacctttagattataaaatctgtgaaaggttaacaggcattctgaattatgttggtccttttactaaatgtggttatgctgctctccttcctttgtatcaagctacttcgcgtacggcatttgtgttttcttctctctaccacatctggttgctgtccctttatgctgagttgtggcctgttgccaggcaacgaggcgtggtgtgctctgtgtctgacgcaaccccctctggttggggcatttgcaccacctatcaactcatttccccgacgggcgcttttgccctgccgatcgccaccgcggacgtcatcgccgcatgccttgcgcgctgctggacaggcgctcggctgttaggcactgacaactcggtggttctttcgggcaaactgacttcctttccttggctgctcgcctctgttgccaactggattcttcgcgggacgtcgttctgctacgtgccttcggcagcgaatccggcggaccttccttctcgaggccttctgccggctctgcatcccgtgccgactctccgcttccgtccgcagctgagtcgcatctccctttggcccgcctccccggggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaatttcaccgtccttgacacgaagtttgctcgagccacc

SEQ ID NO: 675 - DNA, 2464 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatagacaagcaggggatggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgttctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaaggtgttgtgaaaaccaccgctaattcaaatccgccacc

SEQ ID NO: 676 - DNA, 3050 bp, Artificial sequence
  Synthetic
ccgcctaggacaacctttagattataaaatctgtgaaaggttaacaggcattctgaattatgttggtccttttactaaatgtggttatgctgctctccttcctttgtatcaagctacttcgcgtacggcatttgtgttttcttctctctaccacatctggttgctgtccctttatgctgagttgtggcctgttgccaggcaacgaggcgtggtgtgctctgtgtctgacgcaaccccctctggttggggcatttgcaccacctatcaactcatttccccgacgggcgcttttgccctgccgatcgccaccgcggacgtcatcgccgcatgccttgcgcgctgctggacaggcgctcggctgttaggcactgacaactcggtggttctttcgggcaaactgacttcctttccttggctgctcgcctctgttgccaactggattcttcgcgggacgtcgttctgctacgtgccttcggcagcgaatccggcggaccttccttctcgaggccttctgccggctctgcatcccgtgccgactctccgcttccgtccgcagctgagtcgcatctccctttggcccgcctccccggggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatagacaagcaggggatggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgttctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaaggtgttgtgaaaaccaccgctaattcaaatccgccacc

SEQ ID NO: 677 - DNA, 3198 bp, Artificial sequence
  Synthetic
ccgcctaggacataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcacctggagtggagcaaacctcatcgggaccgacaattctgtcgtactctcccgcaagtcatcatcgtttccttggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatagacaagcaggggatggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgttctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaaggtgttgtgaaaaccaccgctaattcaaatccgccacc

SEQ ID NO: 678 - DNA, 2165 bp, Artificial sequence
  Synthetic
gctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaacggtccgaatttcaaagtctttttcctattgacctacaaggttttcaagaatcatgttgtaagcaactgtgttctgaggaatctatgtttaaaaacccatccgtggatcttggcccagggtccagagactgagctagccacgccccggccgcgccgcagccactcccacggcagttcaagtgttaagtcccaaagaccgcgctctgtgcatgcgcagacccgtccacagctggctcctagccaacccggccggacgagcacccggcgccgtcacgtgacgcacccaaccggcgtcgacctataaaaggccgggcgttgacgtcagcgttctcttccgccgcagccgccgccatcgtcggcgcgcttccctgttcacctctgactctgagaatccgtcgccatccgccaggtgagtctcctcggctccgctagactcggggaccgagaggaatctctggggcagcgggacgtggctgtagcgggacgctgagagggacgggaggaagagacatggctgccctggcccgggcggcaggacgtggtcgggccgcggcgccatatctgcgcgtccctgagggccttgggagtgtcaactgccgaggtcggggtgttttcttgaagtccttcaactccccgcggccgccggggtgactgcgggaggggttgtgcttggtgatgtggcagcgggcaaagcgccgtccccgcgcccctggtgacgggcggagggtgtcctcgggaggtgacagcctgtagggctggcttccttggacacctccagtgggctgaacgccttccgggccctttccggtagcccccgtgtctgttttctatctgagttcacacgtgagcaccggtccccataatctaagaaagtggctcactgggcctagtggcgcattgtggcctttgatccgggctttgaccttggcgcacagcacccagtggtttggggaagaggtgtgtgtagcagaggaggttttttcgtgctttggtcccaatcaatccggcatctttgcagtgccgaggtggccgtgcaccttggctttgaattcttgtgctgaggttatgtgacttgagcctcaagatagggtgttctagcacaggcttgctcttaagtgtcgcagttgtcggtttcggcgtttgtttagagctgtggacacatctgtgaacttttgatgcttatttcagaggtcctgggttgtacgtttgagtcacactgtgagctcagctccaatcttgggccgacatctggttcctgcccctgctgtggggtgctattgacccaccgatgcctgccaagttgggttcccagaatcagcctggctgcccatccccccaccacaggtgaacttcgtctcaagcttccttcttctttttcctagaagctcagaataaacgctcaactttggccgccacc

SEQ ID NO: 679 - DNA, 2188 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaaggatccaacttctaagtccgttttttattgatctaaaaggccttttgcgaatcatcttgaaggcaatcgcgttctgagccacctcagctttggcacacagcgcggggactgtcgcgaggggtttagggcccaagcaggacacaccccgaaatctccgcagccacccccaccccacgcccccggctcttgagggttaaatcgcaggcgctggttctcgcacgcgcacatcatcccgcaggcgagccccagcacccagcccagggtgcgcgcgcgccgtcacgtgacacgcccaaccggcgtcgccgtataaaagcgcgggcgttgacgtcagcgttctcttccgccgcagccgccgccatcgtcggcgcccctcgcacttctcctgtgcccgtgagaatccgtcgccatccgccaggtgagtgaccccggagcggcggtgctcggggccggagtcggtacctcggggctgcgggacgtgtcggtggcggtccgcggaggccggcctgggaggagacatggctgccggggcggcgggacgtggacggacggggcggctggcgccatgtctgcgcgtcgggctgtggcctcggcacggcggccgttgtcccctcggcggacggtgctgatttggcagtgggcacagccaggcctctggccgccctcgggcgtgggatcgctggtcccgtccccggcggagggccagcgtccctttacgaggtgacagccgggtgggcggacttccgtttgcacatccgcgtcccctgtggccggcctccgcgcgtcacgtcgctgctgtaggaccccctcctgaacggtgacgtgctccctgctaaccaaatggattccgaaggtagcctgggcaagggctctcgcatcccgccatgtggaacccgctggctttgggtggcgcaaagcgtgtcccatgccgagcgtctggaggttctgtgcctccacacgtgtggacccatcgagttgtcatgagtagtgtcctgctgaggttcccacgcacttctaggcactgcttgcttggctgtgaagctggggtggcaggcgcagttttgttgcctgtggatgcgttggaagattgggggcctttggttattgcggtggtgactgtctttgagatagggtttcacgtagcccaggcttgctcaggtggttagttcagggtttgtttagttagggctggacttctgacgtgctggctgtggactcttgatctgtatgctaacgaggtgcttgggcttgcaggctcgagtcaccgcggactcactgttccttatgaatgacaaccgaggctccatcttgggctgacggtcgtggttgtagtggctgtgtgcgcactggagtgttgtgtgggcaggccacggccacgcgtgggaaacgacatgctgctgcctgcagtttgctcagctgcccctcccccatcccaggtgaacttcgtctcaagcttccttcttctttttcctagaagctcagaataaacgctcaactttggccgccacc

SEQ ID NO: 680 - DNA, 1695 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaaaaatcgataatatatggtagggttcatagccagagtaacctttttttttaatttttattttattttatttttgagtcgggcgcgccaaaatgaagtgaagttcctatactttctagacgaagaacaacgaggagaagatcctcaacttttccgcagccttttcaataatggggagaggttcgatgatgcagtggcagggtgacccacacttctccatttcccctgttctcccattttactcgggaagcagcattcaggtttctgggtcctggatgtccttggtgcacactccaaggactcctcgtccttaagttcatagtctgtattccctgagtcctatcctgggaaccatcacccggtcacctcctgagcggggcaatctcagctcccctccccctatcagttcggagcccacacgcttggtgcgtgcacatttcaaaaatgaggcgggtccaaagagagggaggaggggaaatgagagaggcccagctactcgcggctttacgggtgcacgtagctcaggcctctgcgcccttgagctaggactggataagcagggcgggaggcggggcgcgcgtcatcagctcccccccaccatccgggttcctataaatacggactgcagccctccctggtgctctctgctcctccctgttccagagtcggccgcatcttcttgtgcagtgccaggtgaaaatcgcggagtgggccgcaggaggccggggacagtcggaaactgggaaggggagtgggcactgtacgggtctagggatgctggtgcgaagtgtgcaagccggacccaggctccgcattgcaggggggggatgatggaggacgtgatggggcgcacggcgggaatggaggcggggtgggggaggggactgcctggtgtccttcgggccacgctaatctcattttcttctcctgcagcctcgtcccgtagacaaacgtctcaagcttccttcttctttttcctagaagctcagaataaacgctcaactttggccgccacc

SEQ ID NO: 681 - DNA, 1396 bp, Artificial sequence
  Synthetic
gctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaaaaatcgataatatatggtagggttcatagccagagtaacctttttttttaatttttattttattttatttttgagtcgggcgcgccaaaatgaagtgaagttcctatactttctagacggggttggggttgcgccttttccaaggcagccctgggtttgcgcagggacgcggctgctctgggcgtggttccgggaaacgcagcggcgccgaccctgggcctcgcacattcttcacgtccgttcgcagcgtcacccggatcttcgccgctacccttgtgggccccccggcgacgcttcctcgtccgcccctaagtcgggaaggttccttgcggttcgcggcgtgccggacgtgacaaacggaagccgcacgactcactagtaccctcgcagacggacagcgccagggagcaatggcagcgcgccgaccgcgatgggctgtggccaatagcggctgctcagcagggcgcgccgagagcagcggccgggaaggggcggtgcgggaggcggggtgtggggcggtagtgtgggccctgttcctgcccgcgcggtgttccgcattctgcaagcctccggagcgcacgtccgtctcaagcttccttcttctttttcctagaagctcagaataaacgctcaactttggccgccacc

SEQ ID NO: 682 - DNA, 2304 bp, Artificial sequence
  Synthetic
gctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaagttaaatgagaaacctgtgtgttcctttggggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgttctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaaggtgttgtgaaaaccaccgctaattcaaatccaacagcttgcttgttctttttgcagaagctcagaataaacgctcaactttggccgccacc

SEQ ID NO: 683 - DNA, 2190 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaacctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 684 - DNA, 1750 bp, Artificial sequence
  Synthetic
cttgctcacctcgagtacgatagccggctaatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggtattcggacggtgacgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaatttcaccgtccttgacacgaagtttgctcgaagcttccttcttctttttcctagaagctcagaataaacgctcaactttggccgccacc

SEQ ID NO: 685 - DNA, 1852 bp, Artificial sequence
  Synthetic
cttgctcacctcgagtacgatagccggctaatcagccatggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctattcggacggtgacgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggtagcttccttcttctttttcctagaagctcagaataaacgctcaactttggccgccacc

SEQ ID NO: 686 - DNA, 1860 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagaattcgtttatcggccaccgaggccaagatctggccgccaattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 687 - DNA, 1692 bp, Artificial sequence
  Synthetic
tggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaaaaatcgataatatatggtagggttcatagccagagtaacctttttttttaatttttattttattttatttttgagtcgggcgcgccaaaatgaagtgaagttcctatactttctagaattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcgtaagtttctgtttccatttcctctcttgtgacacatttcatgactctgcatttacataacccctgactcatggtcttcccactcttgttctctcagagcttccttcttctttttcctagaagctcagaataaacgctcaactttggccgccacc

SEQ ID NO: 688 - DNA, 1790 bp, Artificial sequence
  Synthetic
cttgctcacctcgagtacgatagccggctaatcagccatggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctattcggacggtgacgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacgccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacagtcagatcgcctggagacgccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggtagcttccttcttctttttcctagaagctcagaataaacgctcaactttggccgccacc

SEQ ID NO: 689 - DNA, 1798 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagaattcgtttatcggccaccgaggccaagatctggccgccagccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacagtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 690 - DNA, 1630 bp, Artificial sequence
  Synthetic
tggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaaaaatcgataatatatggtagggttcatagccagagtaacctttttttttaatttttattttattttatttttgagtcgggcgcgccaaaatgaagtgaagttcctatactttctagagccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacagtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcgtaagtttctgtttccatttcctctcttgtgacacatttcatgactctgcatttacataacccctgactcatggtcttcccactcttgttctctcagagcttccttcttctttttcctagaagctcagaataaacgctcaactttggccgccacc

SEQ ID NO: 691 - DNA, 3898 bp, Artificial sequence
  Synthetic
ggggcttgctcacctcgagtacgatagccggctaatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggtattcggacggtgaactgggcctttcgcccgggctaattatggggtgtcgcccttcgctgaaggccctccgcgcctacagctcaagccacatccgaagggggagggagccgggagctgcgcgcggggccgccggggggaggggtggcaccgcccacgccgggcggccacgaagggcggggcagcgggcgcgcgcccggcggggggaggggccgcgcgccgcgcccgctgggaattggggccctagggggagggcggaggcgccgacgaccgcggcacttaccgttcgcggcgtggcgcccggtggtccccaaggggagggaagggggaggcggggcgaggacagtgaccggagtctcctcagcggtggcttttctgcttggcagcctcagcggctggcgccaaaaccggactccgcccacttcctcgcccctgcggtgcgagggtgtggaatcctccagacgctgggggagggggagttgggagcttaaaaactagtacccctttgggaccactttcagcagcgaactctcctgtacaccaggggtcagttccacagacgcgggccaggggtgggtcattgcggcgtgaacaataatttgactagaagttgattcgggtgtttccggaaggggccgagtcaatccgccgagttggggcacggaaaacaaaaagggaaggctactaagatttttctggcgggggttatcattggcgtaactgcagggaccacctcccgggttgagggggctggatctccaggctgcggattaagcccctcccgtcggcgttaatttcaaactgcgcgaccgtttctcacctgccttgcgccaaggcagggggcgggaccctattccaagaggtagtaactagcaggactctagccttccgcaattcattgagcgcatttacggaagtaacgtcgggtactgtctctggccgcaagggtgggaggagtacgcatttggcgtaaggtggggcgtagagccttcccgccattggcggcggatagggcgtttacgcgacggcctgacgtagcggatgacgcgttagtgggggggaaggttctagaaaagcggcggcagcggctctagcggcagtagcagcagcgccgggtcccgtgcggaggtgctcctcgcagagttgtttctcgagcagcggcagttctcactacagcgccaggacgagtccggttcgtgttcgtccgcggagatcgatctctctcatctcgctcggctgcgggaaatcgggctgaagcgactgagtccgcgatggaggtaacgggtttgaaatcaatgagttattgaaaagggcatggcgaggccgttggcgcctcagtggaagtcggccagccgcctccgtgggagagaggcaggaaatcggaccaattcagtagcagtggggcttaaggtttatgaacggggtcttgagcggaggcctgagcgtacaaacagcttccccaccctcagcctcccggcgccatttcccttcactgggggtgggggatggggagctttcacatggcggacgctgccccgctggggtgaaagtggggcgcggaggcgggaattcttattccctttctaaagcacgctgcttcgggggccacggcgactcctcggcgtccgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagataccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttgacacgaagtttgctcgagccgccaccaaaa

SEQ ID NO: 692 - DNA, 2505 bp, Artificial sequence
  Synthetic
ccgcctaggacgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 693 - DNA, 3252 bp, Artificial sequence
  Synthetic
ccgcctaggacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccatgtcctacttttcaagcctccaagctgtgccttggatggctttggggcatggacatagatccctataaagaatttggttcatcttatcagttgttgaattttcttcctttggacgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 694 - DNA, 3231 bp, Artificial sequence
  Synthetic
ccgcctaggacataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 695 - DNA, 3106 bp, Artificial sequence
  Synthetic
ccgcctaggacttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaactcccactggttggggcatttgcaccacctgtcaactcatttccggtactttcggtttctcacttccgattgctaccgcggagcttatagccgcctgccttgctcgctgctggacaggagctcggttgttgggcactgataactccgtggtcctctccggtaagctaacttcgtttccatggctgctcgcctgtgttgccacctggattctgcgcgggacgtccttctgctacgtcccttcggccctcaatccagcggaccttccttcccgcggcctgctgccggctctgcggcctcttccgcgtctgccccttcgccctcagacgagtcggatctccctttgggccgcctccccgcctgtgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 696 - DNA, 3290 bp, Artificial sequence
  Synthetic
ccgcctaggaccaacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctatccatggctgctcgcctgtgttgccaactggattcttcgcgggacgtccttctgttacgtcccctccgcggacaacccagcggaccttccttcccggggacttctgccggctctccgtcctctgccgcttctgcgttttcgtccggtcaccaagcggatatccctgtgggccgcctccccgcctgtgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 697 - DNA, 3226 bp, Artificial sequence
  Synthetic
ccgcctaggacttccactcaacaaacctttagattataaaatctgtgaaaggttaacaggcattctgaattatgttgctccttttactaaatgtggttatgctgctctccttcctttgtatcaagctacttcgcgtacggcatttgtgttttcttctctctaccacagctggttgctgtccctttatgctgagttgtggcctgttgccaggcaacgtggcgtggtgtgctctgtgtctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctatccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacctgcccaaggtcttgcataagaggactcttggactttcagcaatggggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 698 - DNA, 3290 bp, Artificial sequence
  Synthetic
ccgcctaggacgagcatcttaccgccatttattcccatatttgctctgtttttcttgatttgggcatacatttaaatgtagccaaaactaaatggtggggacatcatttacatttcatgggttatgttattactggagcaggaattttaccccaagataaacatgtgcaaaaagtatcaacatatttgaaatccattcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaactcccactggttggggcatttgcaccacctgtcaactcatttccggtactttcggtttctcacttccgattgctaccgcggagcttatagccgcctgccttgctcgctgctggacaggagctcggttgttgggcactgataactccgtggtcctctccggtaagctaacttcgtttccatggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgtgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 699 - DNA, 3284 bp, Artificial sequence
  Synthetic
ccgcctaggaccaacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttccactcaacaaacctttagattataaaatctgtgaaaggttaacaggcattctgaattatgttgctccttttactaaatgtggttatgctgctctccttcctttgtatcaagctacttcgcgtacggcatttgtgttttcttctctctaccacagctggttgctgtccctttatgctgagttgtggcctgttgccaggcaacgtggcgtggtgtgctctgtgtctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgtgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 700 - DNA, 3241 bp, Artificial sequence
  Synthetic
ccgcctaggacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccatgtcctacttttcaagcctccaagctgtgccttggatggctttggggcatggacatagatccctataaagaatttggttcatcttatcagttgttgaattttcttcctttggacatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 701 - DNA, 3095 bp, Artificial sequence
  Synthetic
ccgcctaggacttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaactcccactggttggggcatttgcaccacctgtcaactcatttccggtactttcggtttctcacttccgattgctaccgcggagcttatagccgcctgccttgctcgctgctggacaggagctcggttgttgggcactgataactccgtggtcctctccggtaagctaacttcgtttccatggctgctcgcctgtgttgccacctggattctgcgcgggacgtccttctgctacgtcccttcggccctcaatccagcggaccttccttcccgcggcctgctgccggctctgcggcctcttccgcgtctgccccttcgccctcagacgagtcggatctccctttgggccgcctccccgcctgtatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 702 - DNA, 3279 bp, Artificial sequence
  Synthetic
ccgcctaggaccaacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctatccatggctgctcgcctgtgttgccaactggattcttcgcgggacgtccttctgttacgtcccctccgcggacaacccagcggaccttccttcccggggacttctgccggctctccgtcctctgccgcttctgcgttttcgtccggtcaccaagcggatatccctgtgggccgcctccccgcctgtatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 703 - DNA, 3215 bp, Artificial sequence
  Synthetic
ccgcctaggacttccactcaacaaacctttagattataaaatctgtgaaaggttaacaggcattctgaattatgttgctccttttactaaatgtggttatgctgctctccttcctttgtatcaagctacttcgcgtacggcatttgtgttttcttctctctaccacagctggttgctgtccctttatgctgagttgtggcctgttgccaggcaacgtggcgtggtgtgctctgtgtctgacgcaacccccactggttggggcatttgcaccacctatcaactcatttccccgacgggcgcttttgccctgccgatcgccaccgcggacgtcatcgccgcctgccttgctcgctgctggacaggagctcggctgttgggcactgacaactccgtggttctttcgggcaaactgacttcctatccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacctgcccaaggtcttgcataagaggactcttggactttcagcaatgatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 704 - DNA, 3279 bp, Artificial sequence
  Synthetic
ccgcctaggacgagcatcttaccgccatttattcccatatttgctctgtttttcttgatttgggcatacatttaaatgtagccaaaactaaatggtggggacatcatttacatttcatgggttatgttattactggagcaggaattttaccccaagataaacatgtgcaaaaagtatcaacatatttgaaatccattcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaactcccactggttggggcatttgcaccacctgtcaactcatttccggtactttcggtttctcacttccgattgctaccgcggagcttatagccgcctgccttgctcgctgctggacaggagctcggttgttgggcactgataactccgtggtcctctccggtaagctaacttcgtttccatggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgtatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 705 - DNA, 3273 bp, Artificial sequence
  Synthetic
ccgcctaggaccaacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttccactcaacaaacctttagattataaaatctgtgaaaggttaacaggcattctgaattatgttgctccttttactaaatgtggttatgctgctctccttcctttgtatcaagctacttcgcgtacggcatttgtgttttcttctctctaccacagctggttgctgtccctttatgctgagttgtggcctgttgccaggcaacgtggcgtggtgtgctctgtgtctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgtatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 706 - DNA, 1686 bp, Artificial sequence
  Synthetic
gagcatcttaccgccatttattcccatatttgctctgtttttcttgatttgggcatacatttaaatgtagccaaaactaaatggtggggacatcatttacatttcatgggttatgttattactggagcaggaattttaccccaagataaacatgtgcaaaaagtatcaacatatttgaaatccattcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaactcccactggttggggcatttgcaccacctgtcaactcatttccggtactttcggtttctcacttccgattgctaccgcggagcttatagccgcctgccttgctcgctgctggacaggagctcggttgttgggcactgataactccgtggtcctctccggtaagctaacttcgtttccatggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgttgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacccgtctcaggggcttcgcaggtacacccaagctgtctagagccgccacc

SEQ ID NO: 707 - DNA, 1680 bp, Artificial sequence
  Synthetic
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttccactcaacaaacctttagattataaaatctgtgaaaggttaacaggcattctgaattatgttgctccttttactaaatgtggttatgctgctctccttcctttgtatcaagctacttcgcgtacggcatttgtgttttcttctctctaccacagctggttgctgtccctttatgctgagttgtggcctgttgccaggcaacgtggcgtggtgtgctctgtgtctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgttgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacccgtctcaggggcttcgcaggtacacccaagctgtctagagccgccacc

SEQ ID NO: 708 - DNA, 3235 bp, Artificial sequence
  Synthetic
gagcatcttaccgccatttattcccatatttgctctgtttttcttgatttgggcatacatttaaatgtagccaaaactaaatggtggggacatcatttacatttcatgggttatgttattactggagcaggaattttaccccaagataaacatgtgcaaaaagtatcaacatatttgaaatccattcctgtaaacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaactcccactggttggggcatttgcaccacctgtcaactcatttccggtactttcggtttctcacttccgattgctaccgcggagcttatagccgcctgccttgctcgctgctggacaggagctcggttgttgggcactgataactccgtggtcctctccggtaagctaacttcgtttccatggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 709 - DNA, 3229 bp, Artificial sequence
  Synthetic
caacatcttgagtccctttatgccgctgttaccaattttcttttgtctttgggtatacatttaaaccctaacaaaacaaaaagatggggatattcccttaacttcatgggatatgtaattgggagttggggcacatggccacaggatcatattgtacaaaacttcaaactatgttttagaaaacttccactcaacaaacctttagattataaaatctgtgaaaggttaacaggcattctgaattatgttgctccttttactaaatgtggttatgctgctctccttcctttgtatcaagctacttcgcgtacggcatttgtgttttcttctctctaccacagctggttgctgtccctttatgctgagttgtggcctgttgccaggcaacgtggcgtggtgtgctctgtgtctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctcgcctgtgttgccaactggattcttcgcgggacgtcgttctgctacgtcccttcggcagcgaatccggcggaccttccttcccgaggccttctgccggctctgcatcccgtgccgactctccgcttccgtccgcagctgagtcgcatctccctttgggccgcctccccgcctgtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 710 - DNA, 2184 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcctggggaagtcccagggaccgtcgctaaattctcataacccataatcccggtacccgccccaccacagtgcgaggagcatgcgctcagggctgagcgcggggagagcagagcacacaagctcatagaccctggtcgtggggggaggggcgcactgagcggggggggggggggtgatgggggggaggaccggggagctggcgcggggcaaactgggaaagcggtgtcgtgtgctggctccgccctcttcccgagggtgggggagaacggtatataagtgcggcagtcgccttggacgttcctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 711 - DNA, 2848 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcgagacggacggtagcatccttaggatcgagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtatataagcagagctctccctatcagtgatagagatctccctatcagtgatagagatcgtcgacgagctcagcgtcggtaccgtacctcttccgcatcgctgtctgcgagggccagctgttggggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccagctcgcggttgaggacaaactcttcgcggtctttccagtactcttggatcggaaacccgtcggcctccgaacggtactccgccaccgagggacctgagcgagtccgcatcgaccggatcggaaaacctcggcgccgccacccacc

SEQ ID NO: 712 - DNA, 3231 bp, Artificial sequence; identical to SEQ ID NO: 694
  Synthetic

SEQ ID NO: 713 - DNA, 3260 bp, Artificial sequence
  Synthetic
ccgcctaggacttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggacgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 714 - DNA, 3106 bp, Artificial sequence
  Synthetic
ccgcctaggacttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtctgccccttcgccctcagacgagtcggatctccctttgggccgcctccccgcctgtgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 715 - DNA, 3260 bp, Artificial sequence
  Synthetic
ccgcctaggacttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggacgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 716 - DNA, 3162 bp, Artificial sequence
  Synthetic
ccgcctaggacttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagcactcaccgtttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggacatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 717 - DNA, 3008 bp, Artificial sequence
  Synthetic
ccgcctaggacttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtctgccccttcgccctcagacgagtcggatctccctttgggccgcctccccgcctgtatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 718 - DNA, 3162 bp, Artificial sequence
  Synthetic
ccgcctaggacttcctgttaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccgcggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcccatgtatctttttcacctgtgccttgtttttgcctgtgttccgcgtcctacttttcaagcctccaagctgtgccttgggcggctttggggcatggacatagatccctataaagaatttggttcatcttatcagttgttgaattttcttcctttggacatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 719 - DNA, 1862 bp, Artificial sequence
  Synthetic
cttgctcacctcgagtacgatagccggctaatcagccatggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctattcggacggtgacgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaatttcaccgtccttgacacgaagtttgctgccgccacc

SEQ ID NO: 720 - DNA, 1956 bp, Artificial sequence
  Synthetic
cttgctcacctcgagtacgatagccggctaatcagccagctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctattcggacggtgacgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaatttcaccgtccttgacacgaagtttgctgccgccacc

SEQ ID NO: 721 - DNA, 2541 bp, Artificial sequence
  Synthetic
gctggagcctcggtagccgttcctcctgcccgctgggcctcccaacgggccctcctcccctccttgcaccggcccttcctggtctttgaataaagggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 722 - DNA, 2124 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagaattcgtttatcggccaccgaggccaagatctggccgccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaaaactaccagcttgcttgttctttttgcagaagctcagaataaacgctcaactttggccgccacc

SEQ ID NO: 723 - DNA, 2768 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 724 - DNA, 2143 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 725 - DNA, 2209 bp, Artificial sequence
  Synthetic
gctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 726 - DNA, 2177 bp, Artificial sequence
  Synthetic
gatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 727 - DNA, 2007 bp, Artificial sequence
  Synthetic
gctggagcctcggtagccgttcctcctgcccgctgggcctcccaacgggccctcctcccctccttgcaccggcccttcctggtctttgaataaagtctgagtgggcggcagcctgtgtgtgcctgggttctctctgtcccggaatgtgccaacaatggaggtgtttacctgtctcagaccaaggacctctctgcagctgcatggggctggggagggagaactgcagggagtatgggaggggaagctgaggtgggcctgctcaagagaaggtgctgaaccatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 728 - DNA, 2495 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaataggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 729 - DNA, 1929 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagaattcgtttatcggccaccgaggccaagatctggccgccagcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacaccatctattgcttagcttccttcttctttttcctagaagctcagaataaacgctcaactttggccgccacc

SEQ ID NO: 730 - DNA, 2529 bp, Artificial sequence
  Synthetic
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcctggggaagtcccagggaccgtcgctaaattctcataacccataatcccggtacccgccccaccacagtgcgaggagcatgcgctcagggctgagcgcggggagagcagagcacacaagctcatagaccctggtcgtggggggaggggcgcactgagcggggggggggggggtgatgggggggaggaccggggagctggcgcggggcaaactgggaaagcggtgtcgtgtgctggctccgccctcttcccgagggtgggggagaacggtatataagtgcggcagtcgccttggacgttcctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaaagcttgcttgttctttttgcagaagctcagaataaacgctcaactttggccgccacc

SEQ ID NO: 731 - DNA, 2494 bp, Artificial sequence
  Synthetic
aaatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagccccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcctggggaagtcccagggaccgtcgctaaattctcataacccataatcccggtacccgccccaccacagtgcgaggagcatgcgctcagggctgagcgcggggagagcagagcacacaagctcatagaccctggtcgtggggggaggggcgcactgagcggggggggggggggtgatgggggggaggaccggggagctggcgcggggcaaactgggaaagcggtgtcgtgtgctggctccgccctcttcccgagggtgggggagaacggtatataagtgcggcagtcgccttggacgttcctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 732 - DNA, 2905 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaaaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 733 - DNA, 2937 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaaaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcctggggaagtcccagggaccgtcgctaaattctcataacccataatcccggtacccgccccaccacagtgcgaggagcatgcgctcagggctgagcgcggggagagcagagcacacaagctcatagaccctggtcgtggggggaggggcgcactgagcggggggggggggggtgatgggggggaggaccggggagctggcgcggggcaaactgggaaagcggtgtcgtgtgctggctccgccctcttcccgagggtgggggagaacggtatataagtgcggcagtcgccttggacgttcctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaaagcttgcttgttctttttgcagaagctcagaataaacgctcaactttggccgccacc

SEQ ID NO: 734 - DNA, 2859 bp, Artificial sequence
  Synthetic
caccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagagggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaagccgccaccatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 735 - DNA, 2914 bp, Artificial sequence
  Synthetic
ccgcctaggaccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagagggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaagccgccaccgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 736 - DNA, 2527 bp, Artificial sequence
  Synthetic
caccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagagggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaagccgccaccgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaacc

SEQ ID NO: 737 - DNA, 2747 bp, Artificial sequence
  Synthetic
ggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaattcatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 738 - DNA, 2415 bp, Artificial sequence
  Synthetic
ggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaattcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaacc

SEQ ID NO: 739 - DNA, 2802 bp, Artificial sequence
  Synthetic
ccgcctaggacggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaattcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaagccgccacc

SEQ ID NO: 740 - DNA, 2399 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaataggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaattcgtttatcggccaccgaggccaagatctggccgccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaaaactaccagcttgcttgttctttttgcagaagctcagaataaacgctcaactttggccgccacc

SEQ ID NO: 741 - DNA, 2872 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaaaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatagacaagcaggggatggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgttctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaaggtgttgtgaaaaccaccgctaattcaaatccgccacc

SEQ ID NO: 742 - DNA, 2508 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaaggtaattcgtagcatccttaggatcgagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacatacataaggtcaataggggtgactagtaaatcaacgggacctcttcatcctcttcctcaatctcgctttctctctcgcttttttttttttcttcttctttttttttttttttttcaaaaggaggggagagggggtaaaaaaatgctgcactgtgcggcgaggccggtgagtgagcgacgcggagccaatcagcgcccgccgttccgaaagttgccttttatggctcgagtggccgctgtggcgtcctataaaacccggcggcgcaacgcgcagccactgtcgagtcgcgtccacccgcgagcacagcttctttgcagctccttcgttgccggtccacacccgccaccaggtaagcagggacgccgggcccagcgggccttcgctctctcgtggctagtacctcactgcagggtcctgaggatcactcagaacggacaccatgggcgggtggagggtggtgccgggccgcggagcggacactggcacagccaactttacgcctagcgtgtagactctttgcagccacattcccgcggtgtagacactcgtgggcccgctcccgctcggtgcgtggggcttggggacacactagggtcgcggtgtgggcatttgatgagccggtgcggcttgcgggtgttaaaagccgtattaggtccatcttgagagtacacagtattgggaaccagacgctacgatcacgcctcaatggcctctgggtctttgtccaaaccggtttgcctattcggcttgccgggcgggcgggcgggcgggcgggcgcggcagggccggctcggccgggtgggggctgggatgccactgcgcgtgcgctctctatcactgggcatcgaggcgcgtgtgcgctagggagggacctcttcctctccccctcttcctagttagctgcgcgtgcgtattgaggctgggagcgcggctgcccggggttgggcgagggcggggccgttgtccggaaggggcggggtcacagtggcacgggcgccttgtttgcgcttcctgctgggtgtggtcgcctcccgcgcgcgcacaagccgcccgtcggcgcagtgtaggcggagcttgcgcccgtttggggagggggcggaggtctggcttcctgccctaggtccgcctccgggccagcgtttgccttttatggtaataatgcggccggtctgcgcttcctttgtcccctgagcttgggcgcgcgccccctggcggctcgagcccgcggcttgccggaagtgggcagggcggcagcggctgctcttggcggccccgaggtgactatagccttcttttgtgtcttgatagttcgccagcctctgctaaccatgttcatgccttcttctttttcctacagctcctgggcaacgtgctggttaattcaaagcaagccgccacc

SEQ ID NO: 743 - DNA, 2477 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaaggtaattcgtagcatccttaggatcgagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacatacataaggtcaataggggtgactagtaaatcaacgggacacctcttcctcaactcacttctctctactctcacttttttttttcttcttcttttttttttttttttttttttttttttttgcaaaagaagggggtaaaaaaatgctgcactgtcgggcgaggccggtgagtgagcgagccggagccaatcagcgcccgccgttccgaaattgccttttatggctcgagtggccgctgtggcgtcctataaaacccggcggcgcaacgcgcgccactgtcgagtccgcgtccacccgcgagtacaacctccttgcagctcctccgtcccggtccacacccgccaccaggtaagcagggacgtcgggcccagcgggccccaactttaccttggccactacctcgctgcaggatcgtgaggaacactcagaagggacaccgtagaggggtggagcgtggtaccgggccgcggagcagctggcaaagcttaactttcccggcccctagggtgtagagtgtttgcagtcgtattcccgcggtgtggacactcgtgggtacgctcctgcttggtgcgcggggcttggggacacactagagtcgcggtgtgggcatttggagagccggtgcggctgcgggtgttaagccgcatctgtccaccttgaggggcaacagtattggggtcaggcgttacaatcacgctttgatggcctatgggtctttgtccaaaccggttttgccattcggcttggcgggcgcggcggggccgctcggccgggtgggggctgggatgccattgcgcgtgcgcgctctatcactgggcattggggccgtgcgcgctggggagggaactcttcctctccccctcttccgagttaagagttgcgcgtgcgtattgagactaggagcgcggccgccccgggttgggcgagggcgggccgtccaccggaaggggcggggtcgtagcggctaggcgcctgctcgcgcttcctgctgggtgtggtcgcctcccgcgcgcgcactagccgcccgtcgcctcagtgtaggcgggcctgtgcccgtttggggaggggcggaggcctggcttcctgccgtgggtccgcctccgggccagcgtttgccttttatggtaataatgcggctgtcctgcgcttcctttgtcccctgagcttgggcgcgcccctggcggctcgaggccgcggctcgccggaagtgggcagggcggcagcggctgctcttggcggctccgcggtgaccatagccctcttttgtgccttgatagttcgccagcctctgctaaccatgttcatgccttcttctttttcctacagctcctgggcaacgtgctggttaattcaaagcaagccgccacc

SEQ ID NO: 744 - DNA, 2466 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaaggtaattcgtagcatccttaggatcgagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacatacataaggtcaataggggtgactagtaaatcaacgggactctctctttttttttttttttttttttttttttccaaaaggaggggagagggggtaaaaaaatgctgcactgtgcggctaggccggtgagtgagcggcgcggagccaatcagcgctcgccgttccgaaagttgccttttatggctcgagtggccgctgtggcgtcctataaaacccggcggcgcaacgcgcagccactgtcgagtccgcgtccacccgcgagcacaggcctttcgcagctctttcttcgccgctccacacccgccaccaggtaagcagggacaacaggcccagccggccacagccctcccgtgggcagtgaccgcgctgcagggtcgcgggggacactcggcgcggacaccggggaaggctggagggtggtgccgggccgcggagcggacactttcagatccaactttcagtccagggtgtagaccctttacagccgcattgccacggtgtagacaccggtggacccgctctggctcagagcacgcggcttgggggaacccattagggtcgcagtgtgggcgctatgagagccgatgcagctttcgggtgttgaaccgtatctgcccaccttggggggaggacacaaggtcgggagccaaacgccacgatcatgccttggtggcccatgggtctttgtctaaaccggtttgcccatttggcttgccgggcgggcgggcgcggcgggcccggctcggccgggtgggggctgggttgccactgcgcttgcgcgctctatggctgggtattggggcgcgtgcacgctggggagggagcccttcctcttccccctctcccaagttaaacttgcgcgtgcgtattgagacttggagcgcggccaccggggttgggcgagggcggggccgttgtccggaaggggcggggtcgcagaggattcggggcgcctgctcgcgcttcctgctgggtgtggtcgcctcccgcgcgcgcactagaccgcccggcgggggggcgaaggcgggtcttgcgcccgtttggggagggggcggacacctggcttcctgccgtggggccgcctccggaccagcgtttgcctcttatggtaataacgcggccggcctgggcttcatttgtcccctgagtttgggcgcgcgccccctggcggcccgtgaccgcggcttgccggaagtgggcagggcggcaacggctgcgcctagtggcccgccagtgaccgcgaccctcttttgtgccctgatatagttcgccagcctctgctaaccatgttcatgccttcttctttttcctacagctcctgggcaacgtgctggttaattcaaagcaagccgccacc

SEQ ID NO: 745 - DNA, 1728 bp, Artificial sequence
  Synthetic
gctggagcctcggtagccgttcctcctgcccgctgggcctcccaacgggccctcctcccctccttgcaccggcccttcctggtctttgaataaagtttacctgactcatggtcctttcactttcacatgggatttcccagttatgaaattaataaaaatcagtgatttccacatctgtgtgtgcctgtgccaggctgggtggggaacaggaggccgagatgattccgggaactgtcagaaggaataaaaatcaatgatttccacatcctgtctgtcttatgtcttggggggtggggaggccaggaagattccaggaaggtcagagtcaataaaaatcaatggtttccacatctctcagtgcctctatctggaggccaggtagggctggccttgggggagggggaggccagaatgactccaagagctacaggaaggggggagggggaaaaaggccagaataattccaggaaccgccaagaaggaattcgtttatcggccaccgaggccaagatctggccgccagcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacaccatctattgcttagcttccttcttctttttcctagaagctcagaataaacgctcaactttggccgccacc

SEQ ID NO: 746 - DNA, 2053 bp, Artificial sequence
  Synthetic
gctggagcctcggtagccgttcctcctgcccgctgggcctcccaacgggccctcctcccctccttgcaccggcccttcctggtctttgaataaagtttacctgactcatggtcctttcactttcacatgggatttcccagttatgaaattaataaaaatcagtgatttccacatctgtgtgtgcctgtgccaggctgggtggggaacaggaggccgagatgattccgggaactgtcagaaggaataaaaatcaatgatttccacatcctgtctgtcttatgtcttggggggtggggaggccaggaagattccaggaaggtcagagtcaataaaaatcaatggtttccacatctctcagtgcctctatctggaggccaggtagggctggccttgggggagggggaggccagaatgactccaagagctacaggaaggggggagggggaaaaaggccagaataattccaggaaccgccaagaaggaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccagcttccttcttctttttcctagaagctcagaataaacgctcaactttggccgccacc

SEQ ID NO: 747 - DNA, 2023 bp, Artificial sequence
  Synthetic
gctggagcctcggtagccgttcctcctgcccgctgggcctcccaacgggccctcctcccctccttgcaccggcccttcctggtctttgaataaagtttacctgactcatggtcctttcactttcacatgggatttcccagttatgaaattaataaaaatcagtgatttccacatctgtgtgtgcctgtgccaggctgggtggggaacaggaggccgagatgattccgggaactgtcagaaggaataaaaatcaatgatttccacatcctgtctgtcttatgtcttggggggtggggaggccaggaagattccaggaaggtcagagtcaataaaaatcaatggtttccacatctctcagtgcctctatctggaggccaggtagggctggccttgggggagggggaggccagaatgactccaagagctacaggaaggggggagggggaaaaaggccagaataattccaggaaccgccaagaagcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaaaccaccagcttccttcttctttttcctagaagctcagaataaacgctcaactttggccgccacc

SEQ ID NO: 748 - DNA, 2071 bp, Artificial sequence
  Synthetic
gctggagcctcggtagccgttcctcctgcccgctgggcctcccaacgggccctcctcccctccttgcaccggcccttcctggtctttgaataaagtttacctgactcatggtcctttcactttcacatgggatttcccagttatgaaattaataaaaatcagtgatttccacatctgtgtgtgcctgtgccaggctgggtggggaacaggaggccgagatgattccgggaactgtcagaaggaataaaaatcaatgatttccacatcctgtctgtcttatgtcttggggggtggggaggccaggaagattccaggaaggtcagagtcaataaaaatcaatggtttccacatctctcagtgcctctatctggaggccaggtagggctggccttgggggagggggaggccagaatgactccaagagctacaggaaggggggagggggaaaaaggccagaataattccaggaaccgccaagaaggaaacttgatctgtcgccgcaattcaagcttcgtgaggctccggtgcccgtcagtgacctgctatagacaagcaggggatggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgttctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaaggtgttgtgaaaaccaccagcttccttcttctttttcctagaagctcagaataaacgctcaactttggccgccacc

SEQ ID NO: 749 - DNA, 2290 bp, Artificial sequence
  Synthetic
gctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaacctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaaaccaccagcttccttcttctttttcctagaagctcagaataaacgctcaactttggccgccacc

SEQ ID NO: 750 - DNA, 2224 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaacctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaaaccaccagcttccttcttctttttcctagaagctcagaataaacgctcaactttggccgccacc

SEQ ID NO: 751 - DNA, 2272 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagaaacttgatctgtcgccgcaattcaagcttcgtgaggctccggtgcccgtcagtgacctgctatagacaagcaggggatggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgttctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaaggtgttgtgaaaaccaccagcttccttcttctttttcctagaagctcagaataaacgctcaactttggccgccacc

SEQ ID NO: 752 - DNA, 2338 bp, Artificial sequence
  Synthetic
gctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaagaaacttgatctgtcgccgcaattcaagcttcgtgaggctccggtgcccgtcagtgacctgctatagacaagcaggggatggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgttctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaaggtgttgtgaaaaccaccagcttccttcttctttttcctagaagctcagaataaacgctcaactttggccgccacc

SEQ ID NO: 753 - DNA, 1995 bp, Artificial sequence
  Synthetic
gctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaagaattcgtttatcggccaccgaggccaagatctggccgccagcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacaccatctattgcttagcttccttcttctttttcctagaagctcagaataaacgctcaactttggccgccacc

SEQ ID NO: 754 - DNA, 1815 bp, Artificial sequence
  Synthetic
taatcgagtacgatagccggctaatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaattcggacggtgactgcagtgaataataaaatgtgtgtttgtccgaaatacgcgttttgagatttctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagactccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaatttcaccgtccttgacacgaagtttgctgccgccacc

SEQ ID NO: 755 - DNA, 1873 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagaattcgtttatcggccaccgaggccaagatctggccgccaaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacgcagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctacaggtactggcccacagccgtaaagagctgcgggggcgtgagaggggggaatgggtgaggtcaagctggaggcttcttggggttgggtgggccgctgaggggaggggagggcgaggtgacgcgacacccggcctttctgggagagtgggccttgttgacctaaggggggcgagggcagttggcacgcgcacgcgccgacagaaactaacagacattaaccaacagcgattccgtcgcgtttacttgggaggaaggcggaaaagaggtagtttgtgtggcttctggaaaccctaaatttggaatcccagtatgagaatggtgtcccttcttgtgtttcaatgggatttttacttcgcgagtcttgtgggtttggttttgttttcagtttgcctaacaccgtgcttaggtttgaggcagattggagttcggtcgggggagtttgaatatccggaacagttagtggggaaagctgtggacgcttggtaagagagcgctctggattttccgctgttgacgttgaaaccttgaatgacgaatttcgtattaagtgacttagccttgtaaaattgaggggaggcttgcggaatattaacgtatttaaggcattttgaaggaatagttgctaattttgaagaatattaggtgtaaaagcaagaaatacaatgatcctgaggtgacacgcttatgttttacttttaaactaggtcaagcttccttcttctttttcctagaagctcagaataaacgctcaactttggccgccacc

SEQ ID NO: 756 - DNA, 2244 bp, Artificial sequence
  Synthetic
tggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaagaaacttgatctgtcgccgcaattcaagcttcgtgaggctccggtgcccgtcagtgacctgctatagacaagcaggggatggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgttctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaaggtgttgtgaaaaccaccagcttccttcttctttttcctagaagctcagaataaacgctcaactttggccgccacc

SEQ ID NO: 757 - DNA, 2049 bp, Artificial sequence
  Synthetic
ttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 758 - DNA, 1215 bp, Artificial sequence
  Synthetic
gctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaacggtccgaatttcaaagtctttttcctattgacctacaaggttttcaagaatcatgttgtaagcaactgtgttctgaggaatctatgtttaaaaacccatccgtggatcttggcccagggtccagagactgagctagccacgccccggccgcgccgcagccactcccacggcagttcaagtgttaagtcccaaagaccgcgctctgtgcatgcgcagacccgtccacagctggctcctagccaacccggccggacgagcacccggcgccgtcacgtgacgcacccaaccggcgtcgacctataaaaggccgggcgttgacgtcagcgttctcttccgccgcagccgccgccatcgtcggcgcgcttccctgttcacctctgactctgagaatccgtcgccatccgccagagcttccttcttctttttcctagaagctcagaataaacgctcaactttggccgccacc

SEQ ID NO: 759 - DNA, 1155 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaaggatccaacttctaagtccgttttttattgatctaaaaggccttttgcgaatcatcttgaaggcaatcgcgttctgagccacctcagctttggcacacagcgcggggactgtcgcgaggggtttagggcccaagcaggacacaccccgaaatctccgcagccacccccaccccacgcccccggctcttgagggttaaatcgcaggcgctggttctcgcacgcgcacatcatcccgcaggcgagccccagcacccagcccagggtgcgcgcgcgccgtcacgtgacacgcccaaccggcgtcgccgtataaaagcgcgggcgttgacgtcagcgttctcttccgccgcagccgccgccatcgtcggcgcccctcgcacttctcctgtgcccgtgagaatccgtcgccatccgccagagcttccttcttctttttcctagaagctcagaataaacgctcaactttggccgccacc

SEQ ID NO: 760 - DNA, 2707 bp, Artificial sequence
  Synthetic
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaacc

SEQ ID NO: 761 - DNA, 1290 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagggggagcttgcttgttctttttgcagaagctcagaataaacgctcaactttggccgccacc

SEQ ID NO: 762 - DNA, 1382 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaacgaagaacaacgagaagatcctcaacttctcctaagccttttcactaatagggagaagttcgatggggcagccttgggcagacccacacttctgctccatttccctggttcctgcagctctcagattctcccattttattcgggaagcagctttctggtttctgggtcctggatgtccttggtgcacactccaaggactcctcgtccttaatccatagtctgtattccctgagtcctatcctgggaaccctcatccggtcacttcctcggcgggacaatctcagctcccctccccctctcaggtcggagcccacacgcttggtgcgtgcacatttcaaaaacgaggcgggtccaaaaagagggagggggggaatgagagaggcccagctactcgcggctttacgggtgcacgtagctcaggcctctgcgcccttgagctgggactggatgagccgagcgggaggcggggcgcgcgtcatcagctccccccaccatccagttcctataaatacggactgcagccctccctggtgctctctgctcctccctgttctagagacagccgcatcttcttgtgcagtgccaggctctctgctcctcctgttcgacagtcagccgcatcttcttttgcgtcgccagggggagcttgcttgttctttttgcagaagctcagaataaacgctcaactttggccgccacc

SEQ ID NO: 763 - DNA, 1151 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagggtccgaatttcaaagtcctttttattgacttacaaggttttcaaggaaaatcttggaagtaactgtgttccgaagaatctacgtttaaaaaccgacccctggatctttgccttgggtccaaggaccgagctggccacgccccagccgcgccgcagccactcccaaggcagttcaagtgttaagcccgaaaggtagagctctgcgcatgtgcacacccgtccatagctgggtcccagccaaccaggccggaggagcacccgcgccgtcacgtgacgtgcccaaccggcgtcgacctataaaaggccgggcgttgacgtcagcggactcttccgccgcagccgccgccatcgtcggcgcgcttccctgttcacctctgtatttgagaatccgacgccatctgccaccaggggagcttgcttgttctttttgcagaagctcagaataaacgctcaactttggccgccacc

SEQ ID NO: 764 - DNA, 1151 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaacggtccgaatttcaaagtctttttcctattgacctacaaggttttcaagaatcatgttgtaagcaactgtgttctgaggaatctatgtttaaaaacccatccgtggatcttggcccagggtccagagactgagctagccacgccccggccgcgccgcagccactcccacggcagttcaagtgttaagtcccaaagaccgcgctctgtgcatgcgcagacccgtccacagctggctcctagccaacccggccggacgagcacccggcgccgtcacgtgacgcacccaaccggcgtcgacctataaaaggccgggcgttgacgtcagcgttctcttccgccgcagccgccgccatcgtcggcgcgcttccctgttcacctctgactctgagaatccgtcgccatccgccaggggagcttgcttgttctttttgcagaagctcagaataaacgctcaactttggccgccacc

SEQ ID NO: 765 - DNA, 1991 bp, Artificial sequence
  Synthetic
gatccttttccctctgaccagaattatgggaacatcatgaagccccttgagcatctagcttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaaaccaccagcttccttcttctttttcctagaagctcagaataaacgctcaactttggccgccacc

SEQ ID NO: 766 - DNA, 2005 bp, Artificial sequence
  Synthetic
gatccttttccctctgaccagaattatgggaacatcatgaagccccttgagcatctagcttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcgttaaatgagaaacctgtgtgttcctttggggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgttctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaaggtgttgtgaaaaccaccgctaattcaaatccaacagcttgcttgttctttttgcagaagctcagaataaacgctcaactttggccgccacc

SEQ ID NO: 767 - DNA, 2186 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaacctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaagtttttttcttccatttcaggtgttgtgaaagccaccgctaattcaaagcaagccgccacc

SEQ ID NO: 768 - DNA, 2139 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaagtttttttcttccatttcaggtgttgtgaaaaccaccgctaattcaaagcaagccgccacc

SEQ ID NO: 769 - DNA, 2232 bp, Artificial sequence
  Synthetic
gctggagcctcggtagccgttcctcctgcccgctgggcctcccaacgggccctcctcccctccttgcaccggcccttcctggtctttgaataaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagaaacttgatctgtcgccgcaattcaagcttcgtgaggctccggtgcccgtcagtgacctgctatagacaagcaggggatggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgttctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaagtttttttcttccatttcaggtgttgtgaaaaccaccgctaattcaaagcaagccgccacc

SEQ ID NO: 770 - DNA, 2252 bp, Artificial sequence
  Synthetic
gctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaacctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaagtttttttcttccatttcaggtgttgtgaaagccaccgctaattcaaagcaagccgccacc

SEQ ID NO: 771 - DNA, 2205 bp, Artificial sequence
  Synthetic
gctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaagtttttttcttccatttcaggtgttgtgaaaaccaccgctaattcaaagcaagccgccacc

SEQ ID NO: 772 - DNA, 2298 bp, Artificial sequence
  Synthetic
gctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaagaaacttgatctgtcgccgcaattcaagcttcgtgaggctccggtgcccgtcagtgacctgctatagacaagcaggggatggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgttctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaagtttttttcttccatttcaggtgttgtgaaaaccaccgctaattcaaagcaagccgccacc

SEQ ID NO: 773 - DNA, 1953 bp, Artificial sequence
  Synthetic
taatcgagtacgatagccggctaatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaattcggacggtgactgcagtgaataataaaatgtgtgtttgtccgaaatacgcgttttgagatttctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccacc

SEQ ID NO: 774 - DNA, 1881 bp, Artificial sequence
  Synthetic
taatcgagtacgatagccggctaatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaattcggacggtgactgcagtgaataataaaatgtgtgtttgtccgaaatacgcgttttgagatttctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgctgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcctcactcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagactgcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccagcgtctcaggggagcttccttcttctttttcctagaagctcagaataaacgctcaactttggccgccacc

SEQ ID NO: 775 - DNA, 1926 bp, Artificial sequence
  Synthetic
taatcgagtacgatagccggctaatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaattcggacggtgactgcagtgaataataaaatgtgtgtttgtccgaaatacgcgttttgagatttctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgccgtcgcagtcttgggtctgaccacctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagactgcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccagcgtctcaggggagcttccttcttctttttcctagaagctcagaataaacgctcaactttggccgccacc

SEQ ID NO: 776 - DNA, 1713 bp, Artificial sequence
  Synthetic
taatcgagtacgatagccggctaatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaattcggacggtgactgcagtgaataataaaatgtgtgtttgtccgaaatacgcgttttgagatttctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgccgtcgcagtcttgggtctgaccacatccacgctgttttgacctccatagtggacaccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagcgtctcaggggagcttccttcttctttttcctagaagctcagaataaacgctcaactttggccgccacc

SEQ ID NO: 777 - DNA, 2158 bp, Artificial sequence
  Synthetic
tggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaacctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaagtttttttcttccatttcaggtgttgtgaaagccaccgctaattcaaagcaagccgccacc

SEQ ID NO: 778 - DNA, 1752 bp, Artificial sequence
  Synthetic
ttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaatacaatagcaggcatgctggggatgcggtgggctctatgggtacccaggtgctgaagaattgacccggttcctcctgggatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagaattcgtttatcggccaccgaggccaagatctggccgccagccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacagtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacagcttgcttgttctttttgcagaagctcagaataaacgctcaactttggccgccacc

SEQ ID NO: 779 - DNA, 2433 bp, Artificial sequence
  Synthetic
tggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcatattacccctaacacctgccaccccagtcttaatcagtggtggaagaactctcagaactgtttgtctcaattggccatttaagtttaatagtgaaagactggttaatgataacaatgcatcggaaaaccttcaggaggaaaggagaatgttttgtggaacatttttgtgtgtgtggcagttttaagttattagttttcaaaatcagtactttttaatggaaacaacttgaccaaaaatctgtcacagaattttgaacccattaaaagccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgttctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaaggtgttgtgaaaaccaccgctaattcaaatccaacagcttgcttgttctttttgcagaagctcagaataaacgctcaactttggccgccacc

SEQ ID NO: 780 - DNA, 1740 bp, Artificial sequence
  Synthetic
atgagcagccggcgcttcactgccgaagaggctctgttgctgttcttcgactcggacgccgaggaagaaattagcgagatcgaagatctgtcggatgcggaagataacgacatagacgacccggacttccaattttcggacgacgaagaggactcagaggatgagtccgccgtggtgtcccctagcgacgagaacctcggcatggaacagtcctcgtccaccgaagggacctgggcgtcgaaggatggcaacatcaagtggagcactagcccccaccagtcccggggacggctgtcctcatccaacatcatcaagatgacccccggaccgactcggttcgccgtgacccgggtggacgacatccagtccgctttccaactgttcatctcacaacctattgagcggatcatcctggatatgactaacttggaaggccggagagtgttccaggagaagtggaagagtctggaccagaccgatctcaacgcgtacattgggatcctgattctggctggagtgtacaggtccaagggcgaagcaacctcctcgctgtggaacgaagagaacggaaggcccatcttccgagccactatgtccctggagactttccacatgatctcacgcgtgatcagatttgacaatagggacacccgcgtgggccggagagagtccgataagctcgcggccatcagggacgtgtgggacaaatgggtggaaattctgccacttctgtacaaccccggtccgcacgtgaccgtcgacgaaagactggtgccgtttagaggcagatgcccattccggcagtacatgccgaacaagcccgccaaatacgggattaagatctgggccgcctgcgacgccaagtccagctacgcctggaagatgcaagtctatacgggaaagtcccccggtggagcacccgagaagaatcagggaatgcgcgtggtgctcgagatgtccgagggactgcaggggcataacatcacttgcgacaacttcttcacctcataccggctcggggaagaattgcagaagcggaagctcaccatgctcggaactgtgcggcgcaacaagcctgagcttccatccgaaatcctgaagatccagggcagacccatgcacagctcgatcttcgcgttcacggaaaaggccacagtggtgtcctactgccctaagcgcaacaagaacgtcctcgtgatgtccaccatgcatactgatgccagcctgtccacccgcgacgatatgaagccgcagatgattctggactacaattccaccaagggtggagtcgacaatctggataaggtcaccgccacctactcatgccagcgcaagaccgccagatggccgatggccattttcttcaacatcgttgacgtgtccgcctataacgcctacgtgctttggtccgagattaaccaagagtggaacgccggaaagctgtacaggcgccgcctgttcctggaagaactcggcaaagcgctgatcacccctaagattcagcggcgcgcccgcccggctcggagccctgcagccgcggccgtcattgaaaagatcaagttcaggaccagcaaccagtttgctatggatccggtggacactgatgtgaagaagcggaaacggtgtcaagtctgcccgtcacgcgacgactccaagaccagcacttcgtgcgtgaagtgcaagaacttcatctgtcggaagcacactgtgaccttctgtccatcttgcggagagcactga

SEQ ID NO: 781 - DNA, 1740 bp, Artificial sequence
  Synthetic
atgagctccagaagatttacagctgaagaagctttattactgttttttgatagtgatgcagaggaagaaatttcagagatagaggatctttcagatgcagaggacaatgatattgatgatccagattttcaattttccgacgatgaggaggattcagaggacgagtctgccgttgtctctccatcggatgaaaacctgggtatggagcaatcctcatccacagaggggacatgggcatctaaagatggtaatataaaatggtcaacatcaccacaccaaagccgaggcagactgtcatcttccaatatcatcaaaatgacacctggtccaacaagatttgctgtcacacgagttgatgatattcaatcagcatttcagctcttcatatcccaaccaatagagaggattatactggacatgactaacttggaggggaggcgtgtatttcaagagaaatggaagtcactggatcagactgacttgaatgcttatattggaattctgatattagctggagtgtacagatcaaagggagaagcaacttcaagtctatggaatgaagagaatggaagaccaatctttcgagcaacaatgtctctggagacatttcatatgatatctcgtgtgatccgatttgacaaccgtgacaccagagttggtcgacgtgaaagtgacaaactagctgcaatcagagatgtatgggataaatgggtcgaaattctacctttgttgtacaatcccggtccccatgttactgtagatgagcgccttgttccattcagagggcgctgtcctttccgacagtacatgcccaacaagcccgccaagtatggcataaaaatatgggcagcctgtgatgcaaaatctagctatgcatggaaaatgcaagtgtacactggaaaatcacctggaggagcacctgagaagaaccaggggatgcgtgtggtgctcgaaatgagtgaagggctgcaaggtcataacatcacatgtgacaacttctttacatcctaccgccttggggaggaacttcagaagaggaagctgactatgttgggaacagtcagaagaaataagccagaacttcccagtgaaattctcaagatacaggggagacctatgcattcctcaatatttgctttcactgaaaaagcaacagttgtttcatactgcccgaagagaaacaagaatgttcttgtaatgagtacaatgcatacagatgcatctctgagcacaagagatgacatgaagccacaaatgatcctggactacaactccaccaaaggaggagttgacaatctggacaaagtcacagcaacatacagctgccagcgcaagactgctcgttggcccatggcaattttcttcaatattgtggacgtgtctgcctacaatgcctatgtcctgtggtctgaaatcaaccaggaatggaacgccggcaaactgtaccgacgtcggcttttcctggaggaactcggcaaagcactcatcactcccaagatccagaggcgagccaggccagctcgatcaccagcagctgcagctgtcattgaaaagatcaagttcaggacatccaaccagtttgcaatggatccagtggatacagatgtaaagaaacgaaaaagatgccaggtctgtccctcccgagatgacagtaaaacaagtacctcttgtgtaaaatgcaagaatttcatctgcagaaagcacacagttacattctgtccttcatgtggagaacattga

SEQ ID NO: 782 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 783 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHLTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDQVTATYSCQRKTARWPMAIFFNIVDVAAYNAYVLWSEINQEWNAGKLYRRRLFLEELGKALITPKIQRRARPARSPAAAAVIEKIKFRTSNQFAMDPVDTDVKKRKRCQVCPSRDDRKTSTSCVKCKNFICRKHTVTFCPSCGEH

SEQ ID NO: 784 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEPLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVAAYNAYILWSEINQEWNAGKLYRRRLFLEELGKALITPKIQRRARPARSPARAAVIEKIKFRTSNQFAMDPVDTDVKKRKRCQVCPSRDDSKTSTSCVKCKNFICRKHTVTFCPSCGEH

SEQ ID NO: 785 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLELSEGLQGRNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATMSCQRKTARWPMAIFFNIVDVSAYNAYVLWSEINQEWNAGKLYRRRLFLEELGKALITPKIQRRARPARSPAAARVIEKIKFRTSNQFAMDPVDTDVKKRKRCQVCPSRDDSKTSTSCVKCKNFICRKHTVTFCPSCGEH

SEQ ID NO: 786 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVLSTMHTDASLSTRDDMKPQMILFYNSTKGGVDNLDKVTATYSCQRKTARWPMAIFFNIVDVSAYNAYVLWSEINQEWNAGKLYRRRLFLEELGKALITPKIQRRARPARSPAAAAIIEKIKFRTPNQFAMDPVDTDVKKRKRCQVCPSRDDSKTSTSCVKCKNFICRKHTVTFCPSCGEH

SEQ ID NO: 787 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILTGVYRSKREATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGVQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 788 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKREATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATMSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKKFICRKHTVTFCPSCGEH

SEQ ID NO: 789 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVRQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATMSCQRKTARWPMAIFFNIVDVSAYNAYILWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 790 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIIVDMTNLEGRRVFQEKWKSLDQTDLNAYIGILILAAVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDQVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 791 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKKGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSIRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATMSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 792 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMDTDASLSTRDDMKPQMILDYNSTKGGVDNLDKVTATMSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDRKTSTSCVKCKNFICRKHTVTFCPSCGEH

SEQ ID NO: 793 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSSMHTDASLSTRDDMKPQMILFYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKKFICRKHTVTFCPSCGEH

SEQ ID NO: 794 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAAVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGVQGHNITCDNFFTSIRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 795 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKKGNIKWSTSPHQSRGRLSSSNIIKMTPGPTRFAVTRVDDIQSAFQLFISQPIERIILDMTNLEGRRVFQEKWKSTDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEPLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 796 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSCFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGVQGHNITCDNFFTSYRLGEELQKRKLTMLGTVRRNKPELPSEILKIQGRPMHSSIFAFTEKATVVSYCPKRNKNVLVMSTMDTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 797 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHLTVDERLVPFRGRCPFRQYMPNKPAKYGIKIWAACDAKSSYAWKMQVYTGKSPGGAPEKNQGMRVVLEMSEPLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLYSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 798 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGRNITCDNFFTSYRLGEELQKRKLTMLGTVRRNKPELPSEILKIQGRPMHSSIFAFTEKATVVSYCPKRNKNVLVMSTMDTDAELSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 799 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAAVYRSKGEATSSLWNEENGRPIFRATMSLETFHMISRVIRFDNRDTRVGRRESDKLAAIRDVWDKFVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRKDSKTSTSCVKCKNFICRKHTVTFCPSCGEH

SEQ ID NO: 800 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISDPIERIILDMTNLEGRRVFQEKWKSLDQTELNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGVQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 801 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIIVDMTNLEGRRVFQEKWKSLDQTDLNAYIGILILAGVYKSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILFYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 802 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSRETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASLSTRDDMKPQMILFYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 803 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYIPNKPAKYGIKIWAACDAKSSYAWKMQVYTGKSPGGAPEKNQGMRVVLEMSEGLQGHNITCDNFFTSIRLGEELQKRKLTMLGTVRRNKPELPSEILKIQGRPMHSSIFAFTEKATVVSYCPKRNKNVLVMSTMDTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 804 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLELSEGVQGHNITCDNFFTSYRLGEELQKRKLTMLGTVRRNKPEIPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 805 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKREATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGRNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSKDDSKTSTSCVKCKNFICRKHTVTFCPSCGEH

SEQ ID NO: 806 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAFIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNWFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLYSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 807 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAAVYRSKGEATSSLWNEENGRPIFRATMSLETFHMISRVLRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASISTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 808 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGRNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYILWSEINQEWNAGKLYRRRLFLEELGKALITPKIQRRARPARSPAAAAVIEKIKFRTSNQFAMDPVDTDVKKRKRCQVCPSRDDSKTSTSCVKCKKFICRKHTVTFCPSCGEH

SEQ ID NO: 809 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVRQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYIPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILFYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 810 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSNGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMDTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDRSKTSTSCVKCKNFICRKHTVTFCPSCGEH

SEQ ID NO: 811 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSTDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNWFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFYNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 812 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILTGVYRSKGEATSSLWNEENGRPIFRATMSLETFHMISRVIRFDNRDTRVGRRESDKLAAIRDVWDKWVEILPLLYNPGPHVTIDERLVPFRGRCPFRQYMPNKPAKYGIKFWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 813 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILTGVYRSKGEATSSLWNEENGRPIFRATMSLETFHMLSRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSKDDSKTSTSCVKCKNFICRKHTVTFCPSCGEH

SEQ ID NO: 814 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGLLILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVLSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDRKTSTSCVKCKNFICRKHTVTFCPSCGEH

SEQ ID NO: 815 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGLLILAGVYKSNGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 816 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNWFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNSYVIWSEINQEWNAGKLYRRRLFLEELGKALITPKIQRRARPARSPARAAVIEKIKFRTSNQFAMDPVDTDVKKRKRCQVCPSRDDSKTSTSCVKCKNFICRKHTVTFCPSCGEH

SEQ ID NO: 817 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVLRFDNRDTRVGRRESDKLAAIRDVWDKWVEILPLLYNPGPHVTIDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPARAAVIEKIKFRTSNQFAMDPVDTDVKKRKRCQVCPSRDDSKTSTSCVKCKNFICRKHTVTFCPSCGEH

SEQ ID NO: 818 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLELSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDQVTATYSCQRKTARWPMAIFFNIVNVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 819 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSNGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNWFTSYRLGEELQKRKLTMLGTVRRNKPELPSEILKIQGRPMHSSIFAFTEKATVVSYCPKRNKNVLVMSSMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 820 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSNGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKFWAACDAKSSYAWKMQVYTGKSPGGAPEKNQGMRVVLEMSEPLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 821 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKKGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPEIPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNSYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 822 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEPLQGHNITCDNFFTSYRLGEELQKRKLTMLGTVRRNKPELPSEILKIQGRPMHSSIFAFTEKATVVSYCPKRNKNVLVLSTMHTDASISTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 823 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKFVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASISTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPARAAVIEKIKFRTSNQFAMDPVDTDVKKRKRCQVCPSRDDSKTSTSCVKCKNFICRKHTVTFCPSCGEH

SEQ ID NO: 824 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVRQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVAAYNAYVLYSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 825 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISDPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGRNITCDNFFTSYRLGEELQKRKLTMLGTVRRNKPELPSEILKIQGRPMHSSIFAFTEKATVVSYCPKRNKNVLVMSSMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 826 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSRETFHMLSRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVNVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 827 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGLLILAAVYRSKGEATSSLWNEENGRPIFRATMSLETFHMLSRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 828 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAFIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSSMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPARAAVIEKIKFRTSNQFAMDPVDTDVKKRKRCQVCPSRDDSKTSTSCVKCKNFICRKHTVTFCPSCGEH

SEQ ID NO: 829 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDDRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSIRLGEELQKRKLTMLGTVRRNKPELPSEILKIQGRPMHSSIFAFTEKATVVSYCPKRNKNVLVMSSMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 830 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNWFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNILNVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 831 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTELNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVIWSEINQEWNAGKLYRRRLFLEELGKALITPKIQRRARPARSPAAAAVIEKIKFRTSNQFAMDPVDTDVKKRKRCQVCPSRDRRKTSTSCVKCKNFICRKHTVTFCPSCGEH

SEQ ID NO: 832 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIIVDMTNLEGRRVFQEKWKSLDQTDLNAYIGILILAGVYRSKGEATSSLWNEENGRPIFRATMSLERFHMISRVIRFDNRDTRVGRRESDKLAAIRDVWDKWVEILPLLYNPGPHVTVDERLLPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKKFICRKHTVTFCPSCGEH

SEQ ID NO: 833 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASLSTRDDMKPQMILDYNSTKGGVDNLDKVTATYSCQRKTARWPMAIFFNIVDVSAYNAYVLYSEINQEWNAGKLYRRRLFLEELGKALITPKIQRRARPARSPAAAAVIEKIKFRTSNQFAMDPVDTDVKKRKRCQVCPSRKDRKTSTSCVKCKNFICRKHTVTFCPSCGEH

SEQ ID NO: 834 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKFVEILPLLYNPGPHVTIDERLLPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVIWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 835 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAFIGILILAGVYRSNGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDAELSTRDDMKPQMILDYNSTKGGVDNLDKVTATYSCQRKTARWPMAIFFNIVNVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 836 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYKSKREATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVLSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAARVIEKIKFRTSNQFAMDPVDTDVKKRKRCQVCPSRDDSKTSTSCVKCKNFICRKHTVTFCPSCGEH

SEQ ID NO: 837 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLERFHMISRVIRFDNRDTRVGRRESDKLAAIRDVWDKWVEILPLLYNPGPHLTVDERLVPFRGRCPFRQYMPNKPAKYGIKIWAACDAKSSYAWKMQVYTGKSPGGAPEKNQGMRVVLELSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNSYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 838 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSTDQTDLNAYIGILILAGVYRSKGEATSSLWNEENGRPIFRATMSLETFHMISRVIRFDDRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRKDSKTSTSCVKCKKFICRKHTVTFCPSCGEH

SEQ ID NO: 839 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKREATSSLWNEENGRPIFRATMSLETFHMISRVIRFDDRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFYNIVDVSAYNAYVIWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 840 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSCFQLFISQPIERIILDMTNLEGRRVFQEKWKSLDQTDLNAFIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNILDVSAYNAYVLWSEINQEWNAGKLYRRRLFLEELGKALITPKIQRRARPARSPAAAAVIEKIKFRTSNQFAMDPVDTDVKKRKRCQVCPSKDDSKTSTSCVKCKNFICRKHTVTFCPSCGEH

SEQ ID NO: 841 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTELNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDAEISTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 842 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISDPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAIIEKIKFRTSNQFAMDPVDTDVKKRKRCQVCPSKDDSKTSTSCVKCKNFICRKHTVTFCPSCGEH

SEQ ID NO: 843 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKKGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLYSEINQEWNAGKLYRRRLFLEELGKALITPKIQRRARPARSPAAARVIEKIKFRTSNQFAMDPVDTDVKKRKRCQVCPSRDDSKTSTSCVKCKNFICRKHTVTFCPSCGEH

SEQ ID NO: 844 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTELNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWALCDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTPNQFAMDPVDTDVKKRKRCQVCPSRDDSKTSTSCVKCKNFICRKHTVTFCPSCGEH

SEQ ID NO: 845 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTELNAYIGILILAGVYRSKGEATSSLWNEENGRPIFRATMSLETFHMISRVLRFDNRDTRVGRRESDKLAAIRDVWDKFVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 846 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISDPIERIILDMTNLEGRRVFQEKWKSLDQTDLNAFIGILILAGVYRSKGEATSSLWNEENGRPIFRATMSLETFHMISRVIRFDNRDTRVGRRESDKLAAIRDVWDKWVEILPLLYNPGPHVTIDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 847 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILTGVYRSKGEATSSLWNEENGRPIFRATMSLETFHMISRVIRFDNRDTRVGRRESDKLAAIRDVWDKWVEILPLLYNPGPHVTVDERLLPFRGRCPFRQYIPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 848 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLERFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPEIPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDRSKTSTSCVKCKNFICRKHTVTFCPSCGEH

SEQ ID NO: 849 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYKSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASLSTRDDMKPQMILDYNSTKGGVDNLDKVTATYSCQRKTARWPMAIFFNIVNVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 850 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKFVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPEIPSEILKIQGRPMHSSIFAFTEKATVVSYCPKRNKNVLVMSTMHTDASLSTRDDMKPQMILDYNSTKGGVDNLDKVTATYSCQRKTARWPMAIFFNILDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 851 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLERFHMISRVIRFDNRDTRVGRRESDKLAAIRDVWDKWVEILPLLYNPGPHVTVDERLVPFRGRCPFRQYIPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 852 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKKGNIKWSTSPHQSRGRLSSSNIIKMTPGPTRFAVTRVDDIQSAFQLFISQPIERIILDMTNLEGRRVRQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVIWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 853 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSCFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAARVIEKIKFRTSNQFAMDPVDTDVKKRKRCQVCPSRDDSKTSTSCVKCKNFICRKHTVTFCPSCGEH

SEQ ID NO: 854 - protein, 579 aa, Artificial sequence
  Synthetic
MSSRRFTAEEALLLFFDSDAEDEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVRQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLELSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 855 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSTDQTDLNAYIGLLILAGVYRSKGEATSSLWNEENGRPIFRATMSRETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 856 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSCFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWALCDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDRSKTSTSCVKCKNFICRKHTVTFCPSCGEH

SEQ ID NO: 857 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLLPFRGRCPFRQYMPNKPAKYGIKIWALCDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVAAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 858 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNSYILWSEINQEWNAGKLYRRRLFLEELGKALITPKIQRRARPARSPAAAAIIEKIKFRTSNQFAMDPVDTDVKKRKRCQVCPSRDDSKTSTSCVKCKNFICRKHTVTFCPSCGEH

SEQ ID NO: 859 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFYNIVDVSAYNAYVLWSEINQEWNAGKLYRRRLFLEELGKALITPKIQRRARPARSPAAAAVIEKIKFRTPNQFAMDPVDTDVKKRKRCQVCPSKDDSKTSTSCVKCKNFICRKHTVTFCPSCGEH

SEQ ID NO: 860 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYIPNKPAKYGIKFWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRKDSKTSTSCVKCKNFICRKHTVTFCPSCGEH

SEQ ID NO: 861 - protein, 579 aa, Artificial sequence
  Synthetic
MSSRRFTAEEALLLFFDSDAEDEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSCFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHLTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 862 - protein, 579 aa, Artificial sequence
  Synthetic
MSSRRFTAEEALLLFFDSDAEDEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSTDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTPNQFAMDPVDTDVKKRKRCQVCPSRDDSKTSTSCVKCKNFICRKHTVTFCPSCGEH

SEQ ID NO: 863 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILTGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPEIPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAIIEKIKFRTSNQFAMDPVDTDVKKRKRCQVCPSRDDSKTSTSCVKCKNFICRKHTVTFCPSCGEH

SEQ ID NO: 864 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGLLILAGVYRSKGEATSSLWNEENGRPIFRATMSLETFHMISRVIRFDDRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDAELSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 865 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKFWALCDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDAELSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 866 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIIVDMTNLEGRRVFQEKWKSLDQTDLNAYIGILILAGVYRSKGEATSSLWNEENGRPIFRATMSLETFHMLSRVLRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 867 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISDPIERIILDMTNLEGRRVFQEKWKSLDQTDLNAYIGILILAGVYRSKGEATSSLWNEENGRPIFRATMSLETFHMLSRVIRFDNRDTRVGRRESDKLAAIRDVWDKWVEILPLLYNPGPHVTVDERLVPFRGRCPFRQYMPNKPAKYGIKFWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 868 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYKSKGEATSSLWNEENGRPIFRATMSLETFHMISRVIRFDDRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNSYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 869 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASISTRDDMKPQMILDYNSTKGGVDNLDKVTATYSCQRKTARWPMAIFFNILDVAAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 870 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDQVTATYSCQRKTARWPMAIFFNIVDVSAYNAYVLWSEINQEWNAGKLYRRRLFLEELGKALITPKIQRRARPARSPAAARVIEKIKFRTPNQFAMDPVDTDVKKRKRCQVCPSRDDSKTSTSCVKCKNFICRKHTVTFCPSCGEH

SEQ ID NO: 871 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLLPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDQVTATYSCQRKTARWPMAIFFNIVDVSAYNAYVLWSEINQEWNAGKLYRRRLFLEELGKALITPKIQRRARPARSPAAAAIIEKIKFRTSNQFAMDPVDTDVKKRKRCQVCPSRDDSKTSTSCVKCKNFICRKHTVTFCPSCGEH

SEQ ID NO: 872 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSRETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFYNILDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 873 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIIVDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHLTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRKDSKTSTSCVKCKNFICRKHTVTFCPSCGEH

SEQ ID NO: 874 - protein, 579 aa, Artificial sequence
  Synthetic
MSSRRFTAEEALLLFFDSDAEDEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLERFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFYNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 875 - protein, 579 aa, Artificial sequence
  Synthetic
MSSRRFTAEEALLLFFDSDAEDEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVLRFDNRDTRVGRRESDKLAAIRDVWDKWVEILPLLYNPGPHVTVDERLVPFRGRCPFRQYMPNKPAKYGIKIWALCDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 876 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSRETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVLSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDRSKTSTSCVKCKNFICRKHTVTFCPSCGEH

SEQ ID NO: 877 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTIDERLVPFRGRCPFRQYMPNKPAKYGIKIWAACDAKSSYAWKMQVYTGKSPGGAPEKNQGMRVVLEMSEGLQGHNITCDNFFTSIRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYILWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 878 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGLLILAGVYKSNGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWALCDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDRSKTSTSCVKCKNFICRKHTVTFCPSCGEH

SEQ ID NO: 879 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGLLILAGVYKSNGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWALCDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFYNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 880 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGLLILAGVYKSNGEATSSLWNEENGRPIFRATMSLETFHMISRVLRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDRSKTSTSCVKCKNFICRKHTVTFCPSCGEH

SEQ ID NO: 881 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSTDQTDLNAYIGLLILAGVYKSNGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWALCDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 882 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGLLILAGVYKSNGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFYNIVDVSAYNSYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 883 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGLLILAGVYKSNGEATSSLWNEENGRPIFRATMSLETFHMISRVLRFDNRDTRVGRRESDKLAAIRDVWDKWVEILPLLYNPGPHVTVDERLVPFRGRCPFRQYMPNKPAKYGIKIWALCDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 884 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGLLILAGVYKSNGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWALCDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNSYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 885 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGLLILAGVYKSNGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFYNIVDVSAYNAYVLWSEINQEWNAGKLYRRRLFLEELGKALITPKIQRRARPARSPAAAAVIEKIKFRTSNQFAMDPVDTDVKKRKRCQVCPSRDRSKTSTSCVKCKNFICRKHTVTFCPSCGEH

SEQ ID NO: 886 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSTDQTDLNAYIGLLILAGVYKSNGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDRSKTSTSCVKCKNFICRKHTVTFCPSCGEH

SEQ ID NO: 887 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSTDQTDLNAYIGLLILAGVYKSNGEATSSLWNEENGRPIFRATMSLETFHMISRVLRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 888 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGLLILAGVYKSNGEATSSLWNEENGRPIFRATMSLETFHMISRVLRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNSYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 889 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSTDQTDLNAYIGLLILAGVYKSNGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFYNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 890 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGLLILAGVYKSNGEATSSLWNEENGRPIFRATMSLETFHMISRVLRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFYNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 891 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGLLILAGVYKSNGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNSYVLWSEINQEWNAGKLYRRRLFLEELGKALITPKIQRRARPARSPAAAAVIEKIKFRTSNQFAMDPVDTDVKKRKRCQVCPSRDRSKTSTSCVKCKNFICRKHTVTFCPSCGEH

SEQ ID NO: 892 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSTDQTDLNAYIGLLILAGVYKSNGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNSYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 893 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAARVIEKIKFRTSNQFAMDPVDTDVKKRKRCQVCPSRDDSKTSTSCVKCKNFICRKHTVTFCPSCGEH

SEQ ID NO: 894 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASLSTRDDMKPQMILDYNSTKGGVDNLDKVTATYSCQRKTARWPMAIFFNILDVSAYNAYVLWSEINQEWNAGKLYRRRLFLEELGKALITPKIQRRARPARSPAAARVIEKIKFRTSNQFAMDPVDTDVKKRKRCQVCPSRDRSKTSTSCVKCKNFICRKHTVTFCPSCGEH

SEQ ID NO: 895 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLLPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASLSTRDDMKPQMILDYNSTKGGVDNLDKVTATYSCQRKTARWPMAIFFNILDVSAYNAYVLWSEINQEWNAGKLYRRRLFLEELGKALITPKIQRRARPARSPAAARVIEKIKFRTSNQFAMDPVDTDVKKRKRCQVCPSRDDSKTSTSCVKCKNFICRKHTVTFCPSCGEH

SEQ ID NO: 896 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAFIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASISTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAARVIEKIKFRTSNQFAMDPVDTDVKKRKRCQVCPSRDDSKTSTSCVKCKNFICRKHTVTFCPSCGEH

SEQ ID NO: 897 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAFIGILILAGVYRSKGEATSSLWNEENGRPIFRATMSLETFHMISRVIRFDNRDTRVGRRESDKLAAIRDVWDKWVEILPLLYNPGPHVTVDERLLPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAARVIEKIKFRTSNQFAMDPVDTDVKKRKRCQVCPSRDDSKTSTSCVKCKNFICRKHTVTFCPSCGEH

SEQ ID NO: 898 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAFIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAARVIEKIKFRTSNQFAMDPVDTDVKKRKRCQVCPSRDRSKTSTSCVKCKNFICRKHTVTFCPSCGEH

SEQ ID NO: 899 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASISTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAARVIEKIKFRTSNQFAMDPVDTDVKKRKRCQVCPSRDRSKTSTSCVKCKNFICRKHTVTFCPSCGEH

SEQ ID NO: 900 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAFIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASLSTRDDMKPQMILDYNSTKGGVDNLDKVTATYSCQRKTARWPMAIFFNILDVSAYNAYVLWSEINQEWNAGKLYRRRLFLEELGKALITPKIQRRARPARSPAAARVIEKIKFRTSNQFAMDPVDTDVKKRKRCQVCPSRDDSKTSTSCVKCKNFICRKHTVTFCPSCGEH

SEQ ID NO: 901 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLLPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAARVIEKIKFRTSNQFAMDPVDTDVKKRKRCQVCPSRDRSKTSTSCVKCKNFICRKHTVTFCPSCGEH

SEQ ID NO: 902 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASISTRDDMKPQMILDYNSTKGGVDNLDKVTATYSCQRKTARWPMAIFFNILDVSAYNAYVLWSEINQEWNAGKLYRRRLFLEELGKALITPKIQRRARPARSPAAARVIEKIKFRTSNQFAMDPVDTDVKKRKRCQVCPSRDDSKTSTSCVKCKNFICRKHTVTFCPSCGEH

SEQ ID NO: 903 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLLPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASISTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAARVIEKIKFRTSNQFAMDPVDTDVKKRKRCQVCPSRDDSKTSTSCVKCKNFICRKHTVTFCPSCGEH

SEQ ID NO: 904 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASISTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAARVIEKIKFRTSNQFAMDPVDTDVKKRKRCQVCPSRDDSKTSTSCVKCKNFICRKHTVTFCPSCGEH

SEQ ID NO: 905 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAFIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAARVIEKIKFRTSNQFAMDPVDTDVKKRKRCQVCPSRDDSKTSTSCVKCKNFICRKHTVTFCPSCGEH

SEQ ID NO: 906 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLLPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAARVIEKIKFRTSNQFAMDPVDTDVKKRKRCQVCPSRDDSKTSTSCVKCKNFICRKHTVTFCPSCGEH

SEQ ID NO: 907 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASLSTRDDMKPQMILDYNSTKGGVDNLDKVTATYSCQRKTARWPMAIFFNILDVSAYNAYVLWSEINQEWNAGKLYRRRLFLEELGKALITPKIQRRARPARSPAAARVIEKIKFRTSNQFAMDPVDTDVKKRKRCQVCPSRDDSKTSTSCVKCKNFICRKHTVTFCPSCGEH

SEQ ID NO: 908 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATIVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAARVIEKIKFRTSNQFAMDPVDTDVKKRKRCQVCPSRDRSKTSTSCVKCKNFICRKHTVTFCPSCGEH

SEQ ID NO: 909 - protein, 594 aa, Artificial sequence
  Synthetic
MGSSLDDEHILSALLQSDDELVGEDSDSEVSDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTSATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRVYIPNKPSKYGIKILMMCDSGTKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPKEVPGTSDDSTEEPVMKKRTYCTYCPSKIRRKANASCKKCKKVICREHNIDMCQSCF

What is claimed is:

1. A transposon comprising a heterologous polynucleotide between left and right transposon ends, wherein the left end comprises SEQ ID NO: 7 and the right end comprises SEQ ID NO: 8, wherein the transposon is transposable by a transposase having the sequence of SEQ ID NO:782.

2. The transposon of claim 1, further comprising a sequence at least 90% identical to SEQ ID NO: 12 immediately adjacent to the left transposon end and between the left transposon end and the heterologous polynucleotide and a sequence at least 90% identical to SEQ ID NO: 15 immediately adjacent to the right transposon end and between the right transposon end and the heterologous polynucleotide.

3. The transposon of claim 1, wherein the heterologous polynucleotide comprises a heterologous promoter that is active in eukaryotic cells.

4. The transposon of claim 3, wherein the promoter is operably linked to at least one or more of: i) an open reading frame; ii) a nucleic acid encoding a selectable marker; iii) a nucleic acid encoding a counter-selectable marker; iii) a nucleic acid encoding a regulatory protein; iv) a nucleic acid encoding an inhibitory RNA.

5. The transposon of claim 3, wherein the heterologous promoter comprises a sequence selected from SEQ ID NOS: 325-409.

6. The transposon of claim 3, wherein the heterologous polynucleotide comprises in operable linkage with the heterologous promoter, one or more of: i) a nucleic acid encoding a selectable marker; ii) a nucleic acid encoding a counter-selectable marker; iii) a nucleic acid encoding a regulatory protein; and iv) a nucleic acid encoding an inhibitory RNA.

7. The transposon of claim 1, wherein the heterologous polynucleotide comprises a heterologous enhancer that is active in eukaryotic cells.

8. The transposon of claim 7, wherein the heterologous enhancer is selected from SEQ ID NOS: 304-324.

9. The transposon of claim 1, wherein the heterologous polynucleotide comprises a heterologous intron that is spliceable in eukaryotic cells.

10. The transposon of claim 9, wherein the nucleotide sequence of the heterologous intron is selected from SEQ ID NOS: 412-472.

11. The transposon of claim 1, wherein the heterologous polynucleotide comprises an insulator sequence.

12. The transposon of claim 11, wherein the nucleic acid sequence of the insulator is selected from SEQ ID NOS: 286-292.

13. The transposon of claim 1, wherein the heterologous polynucleotide comprises or encodes a selectable marker.

14. The transposon of claim 13, wherein the selectable marker is selected from a glutamine synthetase enzyme, a dihydrofolate reductase enzyme, a puromycin acetyltransferase enzyme, a blasticidin acetyltransferase enzyme, a hygromycin B phosphotransferase enzyme, an aminoglycoside 3'-phosphotransferase enzyme and a fluorescent protein.

15. The transposon of claim 1, wherein the target sequence 5'-TTAA-3' is immediately adjacent to each of SEQ ID NOS:7 and 8 distal from the heterologous polynucleotide.

16. A eukaryotic cell whose genome comprises a transposon comprising a heterologous polynucleotide between left and right transposon ends, wherein the left end comprises SEQ ID NO:7 and the right end comprises SEQ ID NO:8, wherein the transposon is transposable by a transposase having the sequence of SEQ ID NO:782.

17. The eukaryotic cell of claim 16, wherein the cell is an animal cell.

18. The animal cell of claim 17, wherein the cell is a mammalian cell.

19. The mammalian cell of claim 18, wherein the cell is a rodent cell.

20. The mammalian cell of claim 18, wherein the cell is a human cell.

21. The transposon of claim 1, wherein the heterologous polynucleotide comprises two open reading frames, each operably linked to a separate promoter.

22. The transposon of claim 21, wherein the heterologous polynucleotide further comprises a sequence selected from SEQ ID NOS: 596-779.

23. The eukaryotic cell of claim 16, wherein the target sequence 5'-TTAA-3' is immediately adjacent to each of SEQ ID NOS:7 and 8 distal from the heterologous polynucleotide.

* * * * *

UNITED STATES PATENT AND TRADEMARK OFFICE
CERTIFICATE OF CORRECTION

PATENT NO. : 11,060,098 B2  
APPLICATION NO. : 16/842719  
DATED : July 13, 2021  
INVENTOR(S) : Minshull et al.

Page 1 of 2

It is certified that error appears in the above-identified patent and that said Letters Patent is hereby corrected as shown below:

In the Drawings

Please replace Fig. 1 with Fig. 1 as shown on the attached page.

Signed and Sealed this  
Twenty-sixth Day of October, 2021

Drew Hirshfeld  
*Performing the Functions and Duties of the*  
*Under Secretary of Commerce for Intellectual Property and*  
*Director of the United States Patent and Trademark Office*